US012551535B2

(12) United States Patent
Nestor

(10) Patent No.: US 12,551,535 B2
(45) **Date of Patent: *Feb. 17, 2026**

(54) PEPTIDE PHARMACEUTICALS FOR INSULIN RESISTANCE

(71) Applicant: Mederis Diabetes LLC, Sugar Land, TX (US)

(72) Inventor: John J. Nestor, Sugar Land, TX (US)

(73) Assignee: Mederis Diabetes, LLC, Sugar Land, TX (US)

(*) Notice: Subject to any disclaimer, the term of this patent is extended or adjusted under 35 U.S.C. 154(b) by 0 days.

This patent is subject to a terminal disclaimer.

(21) Appl. No.: 18/587,927

(22) Filed: Feb. 26, 2024

(65) Prior Publication Data

US 2024/0424062 A1 Dec. 26, 2024

Related U.S. Application Data

(62) Division of application No. 17/349,195, filed on Jun. 16, 2021, now Pat. No. 11,911,447, which is a division of application No. 14/646,264, filed as application No. PCT/US2013/071077 on Nov. 20, 2013, now Pat. No. 11,065,304.

(60) Provisional application No. 61/728,649, filed on Nov. 20, 2012.

(51) Int. Cl.

| | |
|---|---|
| ***A61K 38/26*** | (2006.01) |
| ***A61K 47/54*** | (2017.01) |
| ***C07K 14/605*** | (2006.01) |
| *A61K 38/00* | (2006.01) |

(52) U.S. Cl.

CPC ............ *A61K 38/26* (2013.01); *A61K 47/549* (2017.08); *C07K 14/605* (2013.01); *A61K 38/00* (2013.01)

(58) Field of Classification Search

None

See application file for complete search history.

(56) References Cited

U.S. PATENT DOCUMENTS

| | | | | |
|---|---|---|---|---|
| 5,574,142 | A | 11/1996 | Meyer, Jr. et al. | |
| 5,661,130 | A | 8/1997 | Meezan et al. | |
| 6,309,633 | B1 | 10/2001 | Ekwuribe et al. | |
| 6,720,407 | B1 | 4/2004 | Hughes et al. | |
| 6,858,580 | B2 | 2/2005 | Ekwuribe et al. | |
| 6,864,069 | B2 | 3/2005 | Pan et al. | |
| 7,138,371 | B2 | 11/2006 | Defrees et al. | |
| 7,390,788 | B2 | 6/2008 | Pert et al. | |
| 8,173,594 | B2 | 5/2012 | Maggio | |
| 8,431,533 | B2 | 4/2013 | Geigle et al. | |
| 8,546,327 | B2 | 10/2013 | Dimarchi et al. | |
| 8,748,376 | B2 | 6/2014 | Ludvigsen et al. | |
| 8,980,830 | B2 | 3/2015 | Dimarchi et al. | |
| 9,150,652 | B2 | 10/2015 | Theuer et al. | |
| 9,178,201 | B2 | 11/2015 | Lee et al. | |
| 9,587,005 | B2 | 3/2017 | Dimarchi et al. | |
| 9,856,306 | B2 * | 1/2018 | Nestor | A61K 47/549 |
| 10,005,817 | B2 | 6/2018 | Nestor | |
| 10,010,617 | B2 | 7/2018 | Nestor et al. | |
| 10,420,844 | B2 | 9/2019 | Nestor et al. | |
| 10,471,127 | B2 | 11/2019 | Nestor et al. | |
| 10,577,405 | B2 | 3/2020 | Nestor | |
| 11,065,304 | B2 | 7/2021 | Nestor | |
| 11,541,028 | B2 * | 1/2023 | Nestor | A61K 31/351 |
| 12,257,229 | B2 * | 3/2025 | Nestor | A61P 1/16 |
| 2003/0202981 | A1 | 10/2003 | Kream | |
| 2004/0137557 | A1 | 7/2004 | Defrees et al. | |
| 2006/0045868 | A1 | 3/2006 | Meezan et al. | |
| 2006/0045869 | A1 | 3/2006 | Meezan et al. | |
| 2007/0111938 | A1 | 5/2007 | Pert et al. | |
| 2008/0200390 | A1 | 8/2008 | Prickett et al. | |
| 2008/0227722 | A1 | 9/2008 | Wang | |
| 2008/0268032 | A1 | 10/2008 | Maggio | |
| 2008/0299079 | A1 | 12/2008 | Maggio et al. | |
| 2009/0305958 | A1 | 12/2009 | Maggio | |
| 2010/0048462 | A1 | 2/2010 | Ryge et al. | |
| 2011/0257096 | A1 | 10/2011 | Maggio | |
| 2013/0035285 | A1 | 2/2013 | Lau et al. | |
| 2014/0314742 | A1 | 10/2014 | Theuer et al. | |
| 2014/0349928 | A1 | 11/2014 | Nestor | |
| 2015/0031630 | A1 | 1/2015 | Nestor | |
| 2015/0290334 | A1 | 10/2015 | Nestor | |
| 2015/0307550 | A1 | 10/2015 | Nestor | |
| 2017/0096468 | A1 | 4/2017 | Nestor | |
| 2018/0194826 | A1 | 7/2018 | Nestor | |
| 2018/0327454 | A1 | 11/2018 | Nestor | |
| 2020/0277351 | A1 | 9/2020 | Nestor | |

(Continued)

FOREIGN PATENT DOCUMENTS

| | | | |
|---|---|---|---|
| CA | 2586771 | A1 | 5/2006 |
| CA | 2702289 | A1 | 5/2009 |

(Continued)

OTHER PUBLICATIONS

Veronese, Francesco M.; "Peptide and protein pegylation: a review of problems and solutions." Biomater. (2001) 22 p. 405-417.*

Ueda, et al., "Chemoenzymatic Synthesis of Glycosylated Glucagon-like Peptide 1: Effect of Glycosylation on Proteolytic Resistance and in Vivo Blood Glucose-Lowering Activity," J. Am. Chem. Soc. 2009; 131(17): 6237-6245.

Underwood et al., "Crystal structure of Glucagon-like Peptide-1 in Complex with Extracellular Domain of the Glucagon-like Peptide-1 Receptor." Journal of Biological Chemistry vol. 285 No. 1 p. 723-730. 2010.

(Continued)

*Primary Examiner* — Fred H Reynolds

(74) *Attorney, Agent, or Firm* — Koren Anderson

(57) ABSTRACT

Described herein are methods of syntheses and therapeutic uses of covalently modified peptides and/or proteins. The covalently modified peptides and/or proteins allow for improved pharmaceutical properties of peptide and protein-based therapeutics.

20 Claims, 32 Drawing Sheets

Specification includes a Sequence Listing.

(56) References Cited

U.S. PATENT DOCUMENTS

| | | | | |
|---|---|---|---|---|
| 2020/0289653 | A1 | 9/2020 | Nestor | |
| 2021/0077629 | A1 | 3/2021 | Nestor | |
| 2021/0290732 | A1 * | 9/2021 | Nestor | A61P 3/04 |

FOREIGN PATENT DOCUMENTS

| | | | |
|---|---|---|---|
| CN | 1635901 | A | 3/2012 |
| CN | 103732617 | A | 4/2014 |
| EP | 1767545 | A1 | 3/2007 |
| EP | 3155017 | A1 | 4/2017 |
| JP | H1160598 | A | 3/1999 |
| JP | 2011524419 | A | 9/2011 |
| KR | 1020020012278 | A | 2/2002 |
| RU | 2181729 | C1 | 4/2002 |
| WO | 9500151 | A1 | 1/1995 |
| WO | 0078302 | A1 | 12/2000 |
| WO | 2004093902 | A1 | 11/2004 |
| WO | 2006064530 | A2 | 6/2006 |
| WO | 2006121860 | A2 | 11/2006 |
| WO | 2007060692 | A2 | 5/2007 |
| WO | 2008052043 | A2 | 5/2008 |
| WO | 2008052043 | A3 | 1/2009 |
| WO | 2009155258 | A2 | 12/2009 |
| WO | 2010151703 | A1 | 12/2010 |
| WO | 2011088837 | A1 | 7/2011 |
| WO | 2011117415 | A1 | 9/2011 |
| WO | 2012088116 | A2 | 6/2012 |
| WO | 2012158962 | A2 | 11/2012 |
| WO | 2012158965 | A2 | 11/2012 |
| WO | 2014081864 | A1 | 5/2014 |
| WO | 2014081872 | A1 | 5/2014 |
| WO | 2015184177 | A1 | 12/2015 |

OTHER PUBLICATIONS

Vinke. Oxidation of carbohydrates and derivatives using carbon supported noble metal catalysts Dissertation, 1981, 156 pages.
Zhou, B, et al., Small Surfactant-like peptides can drive soluble proteins into active aggregates, Microbial Cell Factories, Epub, Jan. 2012, vol. 11, No. 10, pp. 1-8.
"Chain A, Dihydroorotate Dehydrogenase A From Lactococcus Lactis", Genbank, (Oct. 10, 2012), Database accession No. 1DOR_A, URL: NCBI, XP055256755.
Australian Patent Application No. 2012255116 Patent Examination Report No. 1 dated Jun. 14, 2016.
Bachem compound H-8865. 1 page. Downloaded Aug. 23, 2017 from: http://shop.bachem.com/h-8865.html.
Bryant, S., et al. Dmt and opioid peptides: a potent alliance. Biopolymers. 2003;71(2):86-102.
CAS 69227-93-6. n-Dodecyl-β-D-maltoside. Santa Cruz Biotech, 2007.
Chinese Patent Application No. 201280035528.1 Second Office Action dated Sep. 9, 2015 (English translation).
Chinese Patent Application No. 201280035629.9 Third Office Action dated Aug. 16, 2016.
Clodfelter, D.K. et al., "Effects of non-covalent self-association on the subcutaneous absorption of a therapeutic peptide" (1998) Pharm. Res. 15: 254-262.
Condon, S.M. et al., "Analogues of Human Parathyroid Hormone (1-31)NH2: Further Evaluation of the Effect of Conformational Constraint on Biological Activity" (2002) Bioorg. Med. Chem. 10: 731-736.
Constantino L., et al., Peptide-derivatized biodegradable nanoparticles able to cross the blood-brain barrier. Journal of Controlled Release, Nov. 2, 2005;108(1):84-96.
Database—Uniprotkb, accession No. P68955 (GLUC_TRASC), last sequence update: Jul. 21, 1986.
Deacon, et al., "Dipeptidyl peptidase IV resistant analogues of glucagon-like peptide-1 which have extended metabolic stability and improved biological activity." Diabetologia, 1998, 41: 271-278.
Drouillat, B., et al., "Solid phase synthesis of C-terminal carbohydrate modified enkephalins", Bioorg Med Chem Letters, Sep. 9, 1997;7(17):2247-2250.
Egleton and Davis, Development of neuropeptide drugs that cross the blood-brain barrier. The Journal of the American Society for Experimental NeuroTherapeutics, 2:44-53, 2005.
EP12784971.9 Extended European Search Report dated Jan. 12, 2015.
European Patent Application No. 12784971.9 Communication dated Sep. 20, 2016.
European Patent Application No. 12784971.9 Supplementary European Search Report dated Jan. 12, 2015.
European Patent Application No. 12785861.1 Extended European Search Report dated Sep. 12, 2014.
Farkas et al. Chemical conjugation of biomacromolecules: A minireview. Chemical Papers. 2010; 64 (6):683-695.
Ferguson, M.A., et al. Glycosyl-phosphatidylinositol moiety that anchors Trypanosoma brucei variant surface glycoprotein to the membrane, Science, Feb. 12, 1988;239(4841 Pt 1):753-9.
Gijsen, H.J. et al., "Recent Advances in the Chemoenzymatic Synthesis of Carbohydrates and Carbohydrate Mimetics" (1996) Chem. Ver. 96: 443-474.
Guo, Z. and Shao, N. "Glycopeptide and glycoprotein synthesis involving unprotected carbohydrate building blocks" (2005) Med. Res. Ver. 25: 655-678.
Hedley,A.A., et al., Prevalence of overweight and obesity among US children, adolescents, and adults, 1999-2002. JAMA. Jun. 16, 2004;291(23):2847-50.
Hjorth et al., "Glucagon and glucagon like peptide 1: selective receptor recognition via distinct peptide epitopes." J. Biol. Chem (1994) 269(48) p. 30121-30124.
Japanese Patent Application No. 2014-511554 Decision of Rejection dated Oct. 19, 2016.
Jensen, K.J. and Brask, J. "Carbohydrates in Peptide and Protein Design" (2005) Biopolymers 80: 747-761.
Kalyuzhin, O.V., et al., Biological activity of anomeric pairs of lipophilic glycosides of N-Acetylmuramyl-L-Alanyl-D-Isoglutamine. Bulletin of Experimental Biology and Medicine, 2008;145(5):623-625.
Koda, Y., et al., "Synthesis and in vitro evaluation of a library of modified endomorphin 1 peptides", Bioorg Med Chem, Jun. 1, 2008;16(11):6286-6296.
Le Chavelier Isaad et al., "Side chain-to-side chain cyclization by click reaction" (2009) J. Peptide Sci. 15: 451-4.
Li, Y. et al., "Disulfide bond prolongs the half-life of therapeutic peptide-GLP-1" (2011) Peptides 32: 1400-1407.
Liebert, et al, "Systemic Absorption of Insulin and Glucagon Applied Topically to the Eyes of Rats and a Diabetic Dog", Journal of Ocular Pharmacology and Therapeutics Volume, (19950101).
Lindhout, Theresia et al, "Site specific enzymatic polysialylation of therapeutic proteins using bacterial enzymes." PNAS (2011) 108(18) p. 7397-7402.
Maji, S.K. et al., "Amyloid as a Depot for the Formulation of Long-Acting Drugs" (2008) PLoS Biol. 6: e17.
Marcinkowska, A et al., "Lysine-vasopressin analogues with glycogonjugates in position 8." Polish J. Chem. (2006) 80 p. 759-766.
Matsumoto, et al., Stimulation of nonspecific resistance to infection induced by muramyl dipeptide analogs substituted in the gamma-carboxyl group and evaluation of N alpha-muramyl dipeptide-N epsilon-stearoyllysine, Infect Immun, 1983;39(3):1029-40.
Mexican Patent Application No. MX/a/2013/013395 first Office Action dated Aug. 26, 2016 (in Spanish), with reporting letter from the foreign associate (in English).
Miranda, L., et al., Design and Synthesis of Conformationally Constrained Glucagon-Like Peptide-1 Derivatives with Increased Plasma Stability and Prolonged in Vivo Activity, J Med Chem, 2008;51:2758-2765.
Moon et al., "Evolutionary Conserved Residues at Glucagon-like peptide-1 (GLP-1) Receptor Core Confer Ligand- induced receptor activation." The American Society for Biochemistry and Molecular Biology, 2012. Journal of Biological Chemistry vol. 287, No. 6, p. 3873-3884.

(56) References Cited

OTHER PUBLICATIONS

Murage, E.N. et al., (2010) J. Med. Chem. 53: 6412-20.
NCBI Gen Bank accession No. 1DOR A, Oct. 10, 2012, "Chain A, Dihydroorotate Dehydrogenase A From Lactococcus Lactis" downloaded Aug. 18, 2020, 3 pages.
Nonyl beta-D-glucopyranoside chemical structure. PubChem Compound Summary for CID 155448. 17 pages, printed Jan. 12, 2016.
Park, et al., "Mucosal immunity induced by adenovirus-based H5N1 HPAI vaccine confers protection against a lethal H5N2 avian influenza virus challenge," Virology, 2009, 395:182-189.
Paulick, M.G., et al. The glycosylphosphatidylinositol anchor: a complex membrane-anchoring structure for proteins, Biochemistry, Jul. 8, 2008;47(27):6991-7000.
PCT Patent Application No. PCT/US2012/038429 International Preliminary Report on Patentability dated Nov. 19, 2013.
PCT Patent Application No. PCT/US2012/038429 International Search Report dated Mar. 28, 2013.
PCT Patent Application No. PCT/US2012/038429 Written Opinion of the International Searching Authority dated Mar. 28, 2013.
PCT Patent Application No. PCT/US2012/038433 International Preliminary Report on Patentability dated Nov. 19, 2013.
PCT Patent Application No. PCT/US2012/038433 International Search Report dated Oct. 29, 2012.
PCT Patent Application No. PCT/US2012/038433 Written Opinion dated Oct. 29, 2012.
PCT Patent Application No. PCT/US2012/038434 International Preliminary Report on Patentability dated Nov. 19, 2013.
PCT Patent Application No. PCT/US2012/038434 International Search Report dated Nov. 9, 2012.
PCT Patent Application No. PCT/US2012/038434 Written Opinion dated Nov. 9, 2012.
PCT Patent Application No. PCT/US2013/071067 International Preliminary Report on Patentability dated May 26, 2015.
PCT Patent Application No. PCT/US2013/071067 International Search Report dated Feb. 25, 2014.
PCT Patent Application No. PCT/US2013/071077 International Search Report dated Mar. 14, 2014.
PCT Patent Application No. PCT/US2015/033042 International Search Report mailed Aug. 25, 2015.
PCT Patent Application No. PCT/US2015/033042 Written Opinion mailed Aug. 25, 2015.
PCT/US2012/038429 International Preliminary Report on Patentability dated Nov. 19, 2013.
PCT/US2012/038434 International Search Report and Written Opinion dated Nov. 9, 2012.
PCT/US2013/071067 International Search Report dated Feb. 25, 2014.
PCT/US2013/071077 International Search Report dated Mar. 14, 2014.
PCT/US2015/033042 International Search Report and Written Opinion dated Aug. 25, 2015.
Pillion et al., Systemic absorption of insulin and glucagon applied topically to the eyes of rats and a diabetic dog. Journal of Ocular Pharmacology and Therapeutics, 11(3):13 pages, 1995. abstract only.
PubChemCompound, datasheet [online compound summary] retrieved from the Internet: Oct. 27, 2006; See CID 11600623, 9 pages.
PubChemCompound, datasheet [online compound summary] retrieved from the Internet: Oct. 27, 2006; See CID 11708016, 9 pages.
Ribosa, I., et al., Solubilization of Large Unilamellar Liposomes by Alkyl Glycosides. J Colloid Interface Sci, Mar. 15, 1997;187(2):443-6.
RN 115414-60-3 from the original source Zemlyakov et al. (Bioorganicheskaya Khimiya, vol. 13, Issue: 11, pp. 1575-1578, Journal, 1987, CODEN: BIKHD7, ISSN: 0132-3423, published in Russian).
Runge, S. et al., "Crystal Structure of the Ligand-bound Glucagon-like Peptide-1 Receptor Extracellular Domain*" (2008) J. Biol. Chem. 283: 11340-7.
Santa Cruz Biotechnology Product. n-Dodecyl-p-D-maltoside. http://www.scbt.com/datasheet-281071.html downloaded Dec. 28, 2015. (Year: 2015).
Santonicola, et al., "Binding of alkyl polyglucoside surfactants to bacteriorhodopsin and its relation to protein stability," Biophys J., 2008, 94(9):3647-3658.
Sasaki, K., et al., X-ray analysis of glucagon and its relationship to receptor binding, Nature, Oct. 30, 1975;257(5529):751-757.
Saurer, et al., Neuroimmune mechanisms of opioid-mediated conditioned immunomodulation. Brain Behav Immun. Jan. 2008; 22(1): 89-97.
Savic et al., From conventional towards new-natural surfactants in drug delivery systems design: current status and perspectives. Expert Opin Drug Deliv, Mar. 2010;7(3):353-369.
Schiller, "Bi-or-multifunctional opioid peptide drugs," Life Sciences, 2010, 86:598-603.
Shenoy, SK., et all, β-Arrestin-mediated Receptor Trafficking and Signal Transduction, Trends Pharmacol Sci, 2011, 32(9), 521-533.
Son, S., et al., Preparation and Structural, Biochemical, and Pharmaceutical Characterizations of Bile Acid-Modified Long-Acting Exendin-4 Derivatives, J Medical Chem, 2009;52:6889-6896.
Suhara, Y., et al., Peptide-sugar hybrids: Like peptide, like oligosaccharide, Tetrahedron Letters, 1997;38 (41):7167-7170.
U.S. Appl. No. 14/118,546 Office Action dated Aug. 14, 2015.
U.S. Appl. No. 14/118,546 Office Action dated Sep. 6, 2017.
U.S. Appl. No. 14/118,546 Office Action dated Sep. 9, 2016.
U.S. Appl. No. 14/646,246 Office Action dated Dec. 15, 2015.
U.S. Appl. No. 14/646,246 Office Action dated Feb. 7, 2017.
U.S. Appl. No. 14/646,246 Office Action dated Mar. 25, 2016.
U.S. Appl. No. 14/646,246 Office Action dated Sep. 22, 2016.
U.S. Appl. No. 14/646,246 Office Action dated Sep. 6, 2017.
U.S. Appl. No. 14/646,246 Restriction Requirement dated Dec. 15, 2015.
EP13856357.2 Extended European Search Report dated Apr. 21, 2016.
Keresztes,A., et al., Recent advances in endomorphin engineering, ChemMedChem, Aug. 2, 2010;5(8):1179-1196.
Kihlberg, J. et al., "Direct synthesis of glycosylated amino acids from carbohydrate peracetates and Fmoc amino acids: Solid-phase synthesis of biomedicinally interesting glycopeptides" (1997) Methods Enzymol 289: 221-245.
Marcinkowska et al., "Lysine-vasopressin analogues with glycogonjugates in position 8." Polish J. Chem. (2006) 80 p. 759-766.
PCT/US2013/071077 International Preliminary Report on Patentability dated May 26, 2015.

* cited by examiner

Figure 1

Table 1

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A300 | 4 | H | Aib | Q | G | T | F | T | S | D | L | Lys(C8)-# | | | | | | | | | |
| EU-A301 | 5 | H | Aib | Q | G | T | F | T | S | D | L | Lys(C12)-# | | | | | | | | | |
| EU-A302 | 6 | H | Aib | Q | G | T | F | T | S | D | L | Lys(C16)-# | | | | | | | | | |
| EU-A303 | 7 | H | Aib | Q | G | T | F | T | S | D | Bip | Lys(C8)-# | | | | | | | | | |
| EU-A304 | 8 | H | Aib | Q | G | T | F | T | S | D | Bip | Lys(C12)-# | | | | | | | | | |
| EU-A305 | 9 | H | Aib | Q | G | T | F | T | S | D | Bip | Lys(C16)-# | | | | | | | | | |
| EU-A306 | 10 | H | Aib | Q | G | T | F | T | S | D | Nal (2) | Lys(C8)-# | | | | | | | | | |
| EU-A307 | 11 | H | Aib | Q | G | T | F | T | S | D | Nal (2) | Lys(C12)-# | | | | | | | | | |
| EU-A308 | 12 | H | Aib | Q | G | T | F | T | S | D | Nal (2) | Lys(C16)-# | | | | | | | | | |
| EU-A309 | 13 | H | Aib | Q | G | T | 2,6FF | T | S | D | Bip2Et4MeO | Lys(C8)-# | | | | | | | | | |
| EU-A310 | 14 | H | Aib | Q | G | T | 2,6FF | T | S | D | Bip2Et4MeO | Lys(C12)-# | | | | | | | | | |
| EU-A311 | 15 | H | Aib | Q | G | T | 2,6FF | T | S | D | Bip2Et4MeO | Lys(C16)-# | | | | | | | | | |
| EU-A312 | 16 | H | Aib | Q | G | T | F | T | S | D | L | S | K | Y | L | Lys(C8)-# | | | | | |
| EU-A313 | 17 | H | Aib | Q | G | T | F | T | S | D | L | S | K | Y | L | Lys(C12)-# | | | | | |
| EU-A314 | 18 | H | Aib | Q | G | T | F | T | S | D | L | S | K | Y | L | Lys(C16)-# | | | | | |
| EU-A315 | 19 | H | Aib | Q | G | T | F | T | S | D | Bip | S | K | Y | L | Lys(C8)-# | | | | | |
| EU-A316 | 20 | H | Aib | Q | G | T | F | T | S | D | Bip | S | K | Y | L | Lys(C12)-# | | | | | |
| EU-A317 | 21 | H | Aib | Q | G | T | F | T | S | D | Bip | S | K | Y | L | Lys(C16)-# | | | | | |
| EU-A318 | 22 | H | Aib | Q | G | T | F | T | S | D | Nal(2) | S | K | Y | L | Lys(C8)-# | | | | | |
| EU-A319 | 23 | H | Aib | Q | G | T | F | T | S | D | Nal(2) | S | K | Y | L | Lys(C12)-# | | | | | |
| EU-A320 | 24 | H | Aib | Q | G | T | F | T | S | D | Nal(2) | S | K | Y | L | Lys(C16)-# | | | | | |
| EU-A321 | 25 | H | Aib | Q | G | T | 2,6FF | T | S | D | Bip2Et4MeO | S | K | Y | L | Lys(C8)-# | | | | | |
| EU-A322 | 26 | H | Aib | Q | G | T | 2,6FF | T | S | D | Bip2Et4MeO | S | K | Y | L | Lys(C12)-# | | | | | |
| EU-A323 | 27 | H | Aib | Q | G | T | 2,6FF | T | S | D | Bip2Et4MeO | S | K | Y | L | Lys(C16)-# | | | | | |
| EU-A324 | 28 | H | Aib | Q | G | T | F | T | S | D | V | S | K | Y | L | D | G | R | Lys(C8)-# | | |
| EU-A325 | 29 | H | Aib | Q | G | T | F | T | S | D | L | S | K | Y | L | D | G | R | Lys(C8)-# | | |
| EU-A326 | 30 | H | Aib | Q | G | T | F | T | S | D | L | S | K | Y | L | D | G | R | Lys(C12)-# | | |
| EU-A327 | 31 | H | Aib | Q | G | T | F | T | S | D | L | S | K | Y | L | D | G | R | Lys(C16)-# | | |
| EU-A328 | 32 | H | Aib | Q | G | T | F | T | S | D | Bip | S | K | Y | L | D | G | R | Lys(C8)-# | | |

Figure 1 (Continued)
Table 1 (Continued)

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A329 | 33 | H | Aib | Q | G | T | F | T | S | D | Bip | S | K | Y | L | D | G | R | Lys(C12)-# | | |
| EU-A330 | 34 | H | Aib | Q | G | T | F | T | S | D | Bip | S | K | Y | L | D | G | R | Lys(C16)-# | | |
| EU-A331 | 35 | H | Aib | Q | G | T | F | T | S | D | Nal(2) | S | K | Y | L | D | G | R | Lys(C8)-# | | |
| EU-A332 | 36 | H | Aib | Q | G | T | F | T | S | D | Nal(2) | S | K | Y | L | D | G | R | Lys(C12)-# | | |
| EU-A333 | 37 | H | Aib | Q | G | T | F | T | S | D | Nal(2) | S | K | Y | L | D | G | R | Lys(C16)-# | | |
| EU-A334 | 38 | H | Aib | Q | G | T | 2,6FF | T | S | D | Bip2Et4MeO | S | K | Y | L | D | G | R | Lys(C8)-# | | |
| EU-A335 | 39 | H | Aib | Q | G | T | 2,6FF | T | S | D | Bip2Et4MeO | S | K | Y | L | D | G | R | Lys(C12)-# | | |
| EU-A336 | 40 | H | Aib | Q | G | T | 2,6FF | T | S | D | Bip2Et4MeO | S | K | Y | L | D | G | R | Lys(C16)-# | | |
| EU-A337 | 41 | H | Aib | Q | G | T | F | T | S | D | L | Lys(C8)-# | | | | | | | | | |
| EU-A338 | 42 | H | Aib | Q | G | T | F | T | S | D | L | Lys(C12)-# | | | | | | | | | |
| EU-A339 | 43 | H | Aib | Q | G | T | F | T | S | D | L | Lys(C16)-# | | | | | | | | | |
| EU-A340 | 44 | H | Aib | Q | G | T | F | T | S | D | Bip | Lys(C8)-# | | | | | | | | | |
| EU-A341 | 45 | H | Aib | Q | G | T | F | T | S | D | Bip | Lys(C12)-# | | | | | | | | | |
| EU-A342 | 46 | H | Aib | Q | G | T | F | T | S | D | Bip | Lys(C16)-# | | | | | | | | | |
| EU-A343 | 47 | H | Aib | Q | G | T | F | T | S | D | Nal(2) | Lys(C8)-# | | | | | | | | | |
| EU-A344 | 48 | H | Aib | Q | G | T | F | T | S | D | Nal(2) | Lys(C12)-# | | | | | | | | | |
| EU-A345 | 49 | H | Aib | Q | G | T | F | T | S | D | Nal(2) | Lys(C16)-# | | | | | | | | | |
| EU-A346 | 50 | H | Aib | Q | G | T | 2,6FF | T | S | D | Bip2Et4MeO | Lys(C8)-# | | | | | | | | | |
| EU-A347 | 51 | H | Aib | Q | G | T | 2,6FF | T | S | D | Bip2Et4MeO | Lys(C12)-# | | | | | | | | | |
| EU-A348 | 52 | H | Aib | Q | G | T | 2,6FF | T | S | D | Bip2Et4MeO | Lys(C16)-# | | | | | | | | | |
| EU-A349 | 53 | H | Aib | Q | G | T | 2,6MeF | T | S | D | Bip | Lys(C8)-# | | | | | | | | | |
| EU-A350 | 54 | H | Aib | Q | G | T | 2,6MeF | T | S | D | Bip | Lys(C12)-# | | | | | | | | | |
| EU-A351 | 55 | H | Aib | Q | G | T | 2,6MeF | T | S | D | Bip | Lys(C16)-# | | | | | | | | | |
| EU-A352 | 56 | H | Aib | Q | G | T | MeF | T | S | D | L | S | K | Y | L | Lys(C8)-# | | | | | |
| EU-A353 | 57 | H | Aib | Q | G | T | MeF | T | S | D | L | S | K | Y | L | Lys(C12)-# | | | | | |
| EU-A354 | 58 | H | Aib | Q | G | T | MeF | T | S | D | L | S | K | Y | L | Lys(C16)-# | | | | | |
| EU-A355 | 59 | H | Aib | Q | G | T | MeF | T | S | D | Bip | S | K | Y | L | Lys(C8)-# | | | | | |
| EU-A356 | 60 | H | Aib | Q | G | T | MeF | T | S | D | Bip | S | K | Y | L | Lys(C12)-# | | | | | |
| EU-A357 | 61 | H | Aib | Q | G | T | MeF | T | S | D | Bip | S | K | Y | L | Lys(C16)-# | | | | | |
| EU-A358 | 62 | H | Aib | Q | G | T | MeF | T | S | D | Nal(2) | S | K | Y | L | Lys(C8)-# | | | | | |

Figure 1 (Continued)
Table 1 (Continued)

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A359 | 63 | H | Aib | Q | G | T | MeF | T | S | D | Nal(2) | S | K | Y | L | Lys(C12)-# | | | | | |
| EU-A360 | 64 | H | Aib | Q | G | T | MeF | T | S | D | Nal(2) | S | K | Y | L | Lys(C16)-# | | | | | |
| EU-A361 | 65 | H | Aib | Q | G | T | MeF | T | S | D | Bip2Et4MeO | S | K | Y | L | Lys(C8)-# | | | | | |
| EU-A362 | 66 | H | Aib | Q | G | T | MeF | T | S | D | Bip2Et4MeO | S | K | Y | L | Lys(C12)-# | | | | | |
| EU-A363 | 67 | H | Aib | Q | G | T | MeF | T | S | D | Bip2Et4MeO | S | K | Y | L | Lys(C16)-# | | | | | |
| EU-A364 | 68 | H | Aib | Q | G | T | F | T | S | D | V | S | K | Y | L | E | S | Lys(C8)-# | | | |
| EU-A365 | 69 | H | Aib | Q | G | T | F | T | S | D | L | S | K | Y | L | E | S | Lys(C8)-# | | | |
| EU-A366 | 70 | H | Aib | Q | G | T | F | T | S | D | L | S | K | Y | L | E | S | Lys(C12)-# | | | |
| EU-A367 | 71 | H | Aib | Q | G | T | F | T | S | D | L | S | K | Y | L | E | S | Lys(C16)-# | | | |
| EU-A368 | 72 | H | Aib | Q | G | T | F | T | S | D | Bip | S | K | Y | L | E | S | Lys(C8)-# | | | |
| EU-A369 | 73 | H | Aib | Q | G | T | F | T | S | D | Bip | S | K | Y | L | E | S | Lys(C12)-# | | | |
| EU-A370 | 74 | H | Aib | Q | G | T | F | T | S | D | Bip | S | K | Y | L | E | S | Lys(C16)-# | | | |
| EU-A371 | 75 | H | Aib | Q | G | T | F | T | S | D | Nal(2) | S | K | Y | L | E | S | Lys(C8)-# | | | |
| EU-A372 | 76 | H | Aib | Q | G | T | F | T | S | D | Nal(2) | S | K | Y | L | E | S | Lys(C12)-# | | | |
| EU-A373 | 77 | H | Aib | Q | G | T | F | T | S | D | Nal(2) | S | K | Y | L | E | S | Lys(C16)-# | | | |
| EU-A374 | 78 | H | Aib | Q | G | T | 2,6FF | T | S | D | Bip2Et4MeO | S | K | Y | L | E | S | Lys(C8)-# | | | |
| EU-A375 | 79 | H | Aib | Q | G | T | 2,6FF | T | S | D | Bip2Et4MeO | S | K | Y | L | E | S | Lys(C12)-# | | | |
| EU-A376 | 80 | H | Aib | Q | G | T | 2,6FF | T | S | D | Bip2Et4MeO | S | K | Y | L | E | S | Lys(C16)-# | | | |
| EU-A377 | 81 | H | Aib | Q | G | T | F | T | S | D | Bip | S | K | Y | L | D | S | Lys(C8)-# | | | |
| EU-A378 | 82 | H | Aib | Q | G | T | F | T | S | D | Bip | S | K | Y | L | D | S | Lys(C12)-# | | | |
| EU-A379 | 83 | H | Aib | Q | G | T | F | T | S | D | Bip | S | K | Y | L | D | S | Lys(C16)-# | | | |
| EU-A380 | 84 | H | Aib | Q | G | T | F | T | S | D | Bip | S | K | Y | L | D | R | Lys(C8)-# | | | |
| EU-A381 | 85 | H | Aib | Q | G | T | F | T | S | D | Bip | S | K | Y | L | D | R | Lys(C12)-# | | | |
| EU-A382 | 86 | H | Aib | Q | G | T | F | T | S | D | Bip | S | K | Y | L | D | R | Lys(C16)-# | | | |
| EU-A383 | 87 | H | Aib | Q | G | T | F | T | S | D | Y | S | K | Y | L | D | R | Lys(C8)-# | | | |
| EU-A384 | 88 | H | Aib | Q | G | T | F | T | S | D | Y | S | K | Y | L | D | R | Lys(C12)-# | | | |
| EU-A385 | 89 | H | Aib | Q | G | T | F | T | S | D | Y | S | K | Y | L | D | R | Lys(C16)-# | | | |
| EU-A386 | 90 | H | Aib | Q | G | T | F | T | S | D | Y | S | K | Y | L | D | Har | Lys(C12)-# | | | |
| EU-A387 | 91 | H | Aib | Q | G | T | F | T | S | D | Bip | S | K | Y | L | E | S | Lys(C12)-# | | | |
| EU-A388 | 92 | H | Aib | Q | G | T | MeF | T | S | D | Bip | S | K | Y | L | E | S | Lys(C12)-# | | | |
| EU-A389 | 93 | H | Aib | Q | G | T | MeF | T | S | D | Bip | S | Aib | Y | L | E | S | Lys(C12)-# | | | |

Figure 1 (Continued)
Table 1 (Continued)

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A390 | 94 | H | Aib | Q | G | T | MeF | T | S | D | Bip | S | K | Y | L | E | Aib | Lys(C12)-# | | | |
| EU-A391 | 95 | H | Aib | Q | G | T | MeF | T | S | D | Y | S | K | Y | L | D | Aib | Lys(C12)-# | | | |
| EU-A392 | 96 | H | Aib | Q | G | T | MeF | T | S | D | Y | Aib | K | Y | L | D | Aib | Lys(C12)-# | | | |
| EU-A393 | 97 | H | Aib | Q | G | T | MeF | T | S | D | Y | Aib | Lys(C12)-# | | | | | | | | |
| EU-A394 | 98 | H | Aib | Q | G | T | MeF | T | S | D | Nal(2) | Aib | Lys(C12)-# | | | | | | | | |
| EU-A395 | 99 | H | Aib | Q | G | T | MeF | T | S | D | Y | S | K | Y | L | D | Aib | Lys(C12) | Aib-# | | |
| EU-A396 | 100 | H | Aib | Q | G | T | MeF | T | S | D | Nal(2) | S | K | Y | L | D | Aib | Lys(C12) | Aib-# | | |
| EU-A397 | 101 | H | Aib | Q | G | T | MeF | T | S | D | Y | Aib | K | Y | L | D | Aib | Lys(C12)-# | | | |
| EU-A398 | 102 | H | Aib | Q | G | T | MeF | T | S | D | Y | Aib | K | Y | L | D | Aib | Lys(C12) | Aib-# | | |
| EU-A399 | 103 | H | Aib | Q | G | T | MeF | T | S | D | Y | S | K | Y | L | D | Aib | Lys(C12) | Aib-# | | |
| EU-A400 | 104 | H | Aib | Q | G | T | MeF | T | S | D | Y | S | K | Y | L | D | R | Aib | Lys(C12) | Aib-# | |
| EU-A401 | 105 | H | Aib | Q | G | T | MeF | T | S | D | Y | Aib | K | Y | L | D | R | Aib | Lys(C12) | Aib-# | |
| EU-A402 | 106 | H | Aib | Q | G | T | MeF | T | S | D | Y | Aib | K | Y | L | D | R | Aib | Lys(C12) | Ac5c-# | |
| EU-A403 | 107 | H | Aib | Q | G | T | MeF | T | S | D | Nal(2) | Aib | K | Y | L | E | R | Aib | Lys(C12)-# | | |
| EU-A404 | 108 | H | Aib | Q | G | T | F | T | S | D | Y | S | K | Y | L | D | Har | Aib | Lys(C8) | Aib-# | |
| EU-A405 | 109 | H | Aib | Q | G | T | F | T | S | D | Y | S | K | Y | L | D | Har | Aib | Lys(C12) | Aib-# | |
| EU-A406 | 110 | H | Aib | Q | G | T | F | T | S | D | Y | S | K | Y | L | D | Har | Aib | Lys(C16) | Aib-# | |
| EU-A407 | 111 | H | Aib | Q | G | T | MeF | T | S | D | Y | Aib | K | Y | Lys(C12-# | | | | | | |
| EU-A408 | 112 | H | Aib | Q | G | T | MeF | T | S | D | Y | Aib | K | Y | Lys(C12) | -NHEt | | | | | |
| EU-A409 | 113 | H | Aib | Q | G | T | MeF | T | S | D | Y | Aib | K | Y | Lys(C12) | Aib-# | | | | | |
| EU-A410 | 114 | H | Aib | Q | G | T | MeF | T | S | D | Y | Aib | K | Y | Lys(C12) | Aib | -NHEt | | | | |
| EU-A411 | 115 | H | Aib | Q | G | T | MeF | T | S | D | Y | Aib | K | Y | Lys(C12) | Ac5c-# | | | | | |
| EU-A412 | 116 | H | Aib | Q | G | T | MeF | T | S | D | Y | S | K | Y | L | D | Aib | Lys(C8)-# | | | |
| EU-A413 | 117 | H | Aib | Q | G | T | MeF | T | S | D | Y | S | K | Y | L | D | Aib | Lys(C16)-# | | | |
| EU-A414 | 118 | H | Aib | Q | G | T | F | T | S | D | Y | S | K | Y | L | D | Aib | Lys(C8)-# | | | |
| EU-A415 | 119 | H | Aib | Q | G | T | F | T | S | D | Y | S | K | Y | L | D | Aib | Lys(C12)-# | | | |
| EU-A416 | 120 | H | Aib | Q | G | T | F | T | S | D | Y | S | K | Y | L | D | Aib | Lys(C16)-# | | | |
| EU-A417 | 121 | H | Aib | Q | G | T | MeF | T | S | D | Y | S | K | Y | L | D | S | Aib | Lys(C8) | Aib-# | |
| EU-A418 | 122 | H | Aib | Q | G | T | MeF | T | S | D | Y | S | K | Y | L | D | S | Aib | Lys(C12) | Aib-# | |
| EU-A419 | 123 | H | Aib | Q | G | T | MeF | T | S | D | Y | S | K | Y | L | D | S | Aib | Lys(C16) | Aib-# | |
| EU-A420 | 124 | H | Aib | Q | G | T | MeF | T | S | D | Y | S | K | Y | L | D | S | Aib | Lys(C8) | Ac5c-# | |

Figure 1 (Continued)
Table 1 (Continued)

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A421 | 125 | H | Aib | Q | G | T | MeF | T | S | D | Y | S | K | Y | L | D | S | Aib | Lys(C12) | Ac5c-# | |
| EU-A422 | 126 | H | Aib | Q | G | T | MeF | T | S | D | Y | S | K | Y | L | D | S | Aib | Lys(C16) | Ac5c-# | |
| EU-A423 | 127 | H | Aib | Q | G | T | F | T | S | D | Y | S | K | Y | L | D | S | Aib | Lys(C8) | Ac5c-# | |
| EU-A424 | 128 | H | Aib | Q | G | T | F | T | S | D | Y | S | K | Y | L | D | S | Aib | Lys(C12) | Ac5c-# | |
| EU-A425 | 129 | H | Aib | Q | G | T | F | T | S | D | Y | S | K | Y | L | D | S | Aib | Lys(C16) | Ac5c-# | |

MeF means C-alphaMe-Phe; Har means homoArg; 2,6F-F means 2',6'-difluoro-Phe; Bip2Et4MeO means 2'-ethyl-4'-MeO-biphenylalanine.

Lys(C12) means N-epsilon-(1'-dodecyl beta-D-glucuronyl)-L-lysine and other C numbers mean the corresponding 1'-alkyl glucoronide.

# means amide C-terminus.

Figure 2

Table 2

| | SEQ. ID. NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A426 | 130 | H | Aib | Q | G | T | MeF | T | S | D | Y | S | K | Y | L | D | S | R | Aib | Lys(C8) | Aib-# | | | | | | | | | |
| EU-A427 | 131 | H | Aib | Q | G | T | MeF | T | S | D | Y | S | K | Y | L | D | S | R | Aib | Lys(C12) | Aib-# | | | | | | | | | |
| EU-A428 | 132 | H | Aib | Q | G | T | MeF | T | S | D | Y | S | K | Y | L | D | S | R | Aib | Lys(C16) | Aib-# | | | | | | | | | |
| EU-A429 | 133 | H | Aib | Q | G | T | MeF | T | S | D | Y | S | K | Y | L | D | S | R | Aib | Lys(C8) | Ac5c-# | | | | | | | | | |
| EU-A430 | 134 | H | Aib | Q | G | T | MeF | T | S | D | Y | S | K | Y | L | D | S | R | Aib | Lys(C12) | Ac5c-# | | | | | | | | | |
| EU-A431 | 135 | H | Aib | Q | G | T | MeF | T | S | D | Y | S | K | Y | L | D | S | R | Aib | Lys(C16) | Ac5c-# | | | | | | | | | |
| EU-A432 | 136 | H | Aib | Q | G | T | F | T | S | D | Y | S | K | Y | L | D | S | R | Aib | Lys(C8) | Aib-# | | | | | | | | | |
| EU-A433 | 137 | H | Aib | Q | G | T | F | T | S | D | Y | S | K | Y | L | D | S | R | Aib | Lys(C12) | Aib-# | | | | | | | | | |
| EU-A434 | 138 | H | Aib | Q | G | T | F | T | S | D | Y | S | K | Y | L | D | S | R | Aib | Lys(C16) | Aib-# | | | | | | | | | |
| EU-A435 | 139 | H | Aib | Q | G | T | MeF | T | S | D | Y | S | K | Y | L | D | S | R | Aib | Ala | Q | Lys(C8) | F | Aib-# | | | | | | |
| EU-A436 | 140 | H | Aib | Q | G | T | MeF | T | S | D | Y | S | K | Y | L | D | S | R | Aib | Ala | Q | Lys(C12) | F | Aib-# | | | | | | |
| EU-A437 | 141 | H | Aib | Q | G | T | MeF | T | S | D | Y | S | K | Y | L | D | S | R | Aib | Ala | Q | Lys(C16) | F | Aib-# | | | | | | |
| EU-A438 | 142 | H | Aib | Q | G | T | MeF | T | S | D | Y | S | K | Y | L | D | S | R | Aib | Ala | Q | Lys(C8) | F | Aib-# | | | | | | |
| EU-A439 | 143 | H | Aib | Q | G | T | MeF | T | S | D | Y | S | K | Y | L | D | S | R | Aib | Ala | Q | Lys(C12) | F | Aib-# | | | | | | |
| EU-A440 | 144 | H | Aib | Q | G | T | MeF | T | S | D | Y | S | K | Y | L | D | S | R | Aib | Ala | Q | Lys(C16) | F | Aib-# | | | | | | |
| EU-A441 | 145 | H | Aib | Q | G | T | MeF | T | S | D | Y | S | K | Y | L | D | S | R | Aib | Ala | Q | Lys(C8) | F | Ac5c-# | | | | | | |
| EU-A442 | 146 | H | Aib | Q | G | T | MeF | T | S | D | Y | S | K | Y | L | D | S | R | Aib | Ala | Q | Lys(C12) | F | Ac5c-# | | | | | | |
| EU-A443 | 147 | H | Aib | Q | G | T | MeF | T | S | D | Y | S | K | Y | L | D | S | R | Aib | Ala | Q | Lys(C16) | F | Ac5c-# | | | | | | |
| EU-A435 | 148 | H | Aib | Q | G | T | MeF | T | S | D | Y | S | E* | Y | L | D | K* | R | Aib | Ala | Q | Lys(C8) | F | Aib-# | | | | | | |
| EU-A436 | 149 | H | Aib | Q | G | T | MeF | T | S | D | Y | S | E* | Y | L | D | K* | R | Aib | Ala | Q | Lys(C12) | F | Aib-# | | | | | | |
| EU-A437 | 150 | H | Aib | Q | G | T | MeF | T | S | D | Y | S | E* | Y | L | D | K* | R | Aib | Ala | Q | Lys(C16) | F | Aib-# | | | | | | |

Figure 2 (Continued)
Table 2 (Continued)

| | SEQ. ID. NO. | 1 | | | | 5 | | | | | 10 | | | | | 15 | | | | | 20 | | | | | 25 | | | |
|---|---|---|---|---|---|---|---|---|---|---|---|---|---|---|---|---|---|---|---|---|---|---|---|---|---|---|---|---|---|
| EU-A438 | 151 | H | Aib | Q | G | T | MeF | T | S | D | Y | S | E* | Y | L | D | K* | R | Aib | Ala | Q | Lys(C8) | F | Ac5c-# | | | | | |
| EU-A439 | 152 | H | Aib | Q | G | T | MeF | T | S | D | Y | S | E* | Y | L | D | K* | R | Aib | Ala | Q | Lys(C12) | F | Ac5c-# | | | | | |
| EU-A440 | 153 | H | Aib | Q | G | T | MeF | T | S | D | Y | S | E* | Y | L | D | K* | R | Aib | Ala | Q | Lys(C16) | F | Ac5c-# | | | | | |
| EU-A441 | 154 | H | Aib | Q | G | T | F | T | S | D | Y | S | E* | Y | L | D | K* | R | Aib | Ala | Q | Lys(C8) | F | Ac5c-# | | | | | |
| EU-A442 | 155 | H | Aib | Q | G | T | F | T | S | D | Y | S | E* | Y | L | D | K* | R | Aib | Ala | Q | Lys(C12) | F | Ac5c-# | | | | | |
| EU-A443 | 156 | H | Aib | Q | G | T | F | T | S | D | Y | S | E* | Y | L | D | K* | R | Aib | Ala | Q | Lys(C16) | F | Ac5c-# | | | | | |
| EU-A444 | 157 | H | Aib | Q | G | T | F | T | S | D | Y | S | E* | Y | L | D | K* | R | Aib | Ala | Q | Lys(C8) | F | Aib-# | | | | | |
| EU-A445 | 158 | H | Aib | Q | G | T | F | T | S | D | Y | S | E* | Y | L | D | K* | R | Aib | Ala | Q | Lys(C12) | F | Aib-# | | | | | |
| EU-A446 | 159 | H | Aib | Q | G | T | F | T | S | D | Y | S | E* | Y | L | D | K* | R | Aib | Ala | Q | Lys(C16) | F | Aib-# | | | | | |
| EU-A447 | 160 | H | Aib | Q | G | T | MeF | T | S | D | Y | S | K | Y | L | D | E* | R | Aib | Ala | K* | Lys(C8) | F | Aib-# | | | | | |
| EU-A448 | 161 | H | Aib | Q | G | T | MeF | T | S | D | Y | S | K | Y | L | D | E* | R | Aib | Ala | K* | Lys(C12) | F | Aib-# | | | | | |
| EU-A449 | 162 | H | Aib | Q | G | T | MeF | T | S | D | Y | S | K | Y | L | D | E* | R | Aib | Ala | K* | Lys(C16) | F | Aib-# | | | | | |
| EU-A450 | 163 | H | Aib | Q | G | T | MeF | T | S | D | Y | S | K | Y | L | D | E* | R | Aib | Ala | K* | Lys(C8) | F | Ac5c-# | | | | | |
| EU-A451 | 164 | H | Aib | Q | G | T | MeF | T | S | D | Y | S | K | Y | L | D | K* | R | Aib | Ala | K* | Lys(C12) | F | Ac5c-# | | | | | |
| EU-A452 | 165 | H | Aib | Q | G | T | MeF | T | S | D | Y | S | K | Y | L | D | K* | R | Aib | Ala | K* | Lys(C16) | F | Ac5c-# | | | | | |
| EU-A447 | 166 | H | Aib | Q | G | T | F | T | S | D | Y | S | K | Y | L | D | E* | R | Aib | Ala | K* | Lys(C8) | F | Aib-# | | | | | |
| EU-A448 | 167 | H | Aib | Q | G | T | F | T | S | D | Y | S | K | Y | L | D | E* | R | Aib | Ala | K* | Lys(C12) | F | Aib-# | | | | | |
| EU-A449 | 168 | H | Aib | Q | G | T | F | T | S | D | Y | S | K | Y | L | D | E* | R | Aib | Ala | K* | Lys(C1 | F | Aib-# | | | | | |

Figure 2 (Continued)
Table 2 (Continued)

| | SEQ. ID. NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| | | | | | | | | | | | | | | | | | | | | | | 6) | | | | | | | | |
| EU-A450 | 169 | H | Aib | Q | G | T | F | T | S | D | Y | S | K | Y | L | D | E* | R | Aib | Ala | K* | Lys(C8) | F | Ac5c-# | | | | | | |
| EU-A451 | 170 | H | Aib | Q | G | T | F | T | S | D | Y | S | K | Y | L | D | K* | R | Aib | Ala | K* | Lys(C12) | F | Ac5c-# | | | | | | |
| EU-A452 | 171 | H | Aib | Q | G | T | F | T | S | D | Y | S | K | Y | L | D | K* | R | Aib | Ala | K* | Lys(C16) | F | Ac5c-# | | | | | | |
| EU-A453 | 172 | H | Aib | Q | G | T | F | T | S | D | Y | S | K | Y | L | D | E* | Q | A | A | K* | Lys(C12) | F | Aib-# | | | | | | |
| EU-A454 | 173 | H | Aib | Q | G | T | F | T | S | D | Y | S | K | Y | L | D | E* | Q | A | A | K* | Lys(C16) | F | Aib-# | | | | | | |
| EU-A455 | 174 | H | Aib | Q | G | T | F | T | S | D | Y | S | K | Y | L | D | E* | R | A | A | K* | Lys(C12) | F | Aib-# | | | | | | |
| EU-A456 | 175 | H | Aib | Q | G | T | F | T | S | D | Y | S | K | Y | L | D | E* | R | A | A | K* | Lys(C16) | F | Aib-# | | | | | | |
| EU-A457 | 176 | H | Aib | Q | G | T | F | T | S | D | Y | S | K | Y | L | D | E* | R | A | A | K* | Lys(C12) | F | Ac5c-# | | | | | | |
| EU-A458 | 177 | H | Aib | Q | G | T | F | T | S | D | Y | S | K | Y | L | D | E* | R | A | A | K* | Lys(C16) | F | Ac5c-# | | | | | | |
| EU-A459 | 178 | H | Aib | Q | G | T | F | T | S | D | Y | S | K | Y | L | D | E* | Q | A | A | K* | Lys(C12) | F | Ac5c-# | | | | | | |
| EU-A460 | 179 | H | Aib | Q | G | T | F | T | S | D | Y | S | R | Y | L | D | E* | R | A | A | K* | Lys(C12) | F | Aib-# | | | | | | |
| EU-A461 | 180 | H | Aib | Q | G | T | F | T | S | D | Y | S | K | Y | L | D | S | Aib | Lys(C12) | Aib-# | | | | | | | | | | |
| EU-A462 | 181 | H | Aib | Q | G | T | F | T | S | D | Y | S | K | Y | L | D | S | R | Lys(C12) | Aib-# | | | | | | | | | | |
| EU-A463 | 182 | H | Aib | Q | G | T | F | T | S | D | Y | S | K | Y | L | D | S | R | Lys(C12) | Ac5c-# | | | | | | | | | | |
| EU-A464 | 183 | H | Aib | Q | G | T | F | T | S | D | Y | S | K | Y | L | D | S | R | Lys(C8) | Aib-# | | | | | | | | | | |
| EU-A465 | 184 | H | Aib | Q | G | T | F | T | S | D | Y | S | K | Y | L | D | S | R | Lys(C16) | Aib-# | | | | | | | | | | |
| EU-A466 | 185 | H | Aib | Q | G | T | F | T | S | D | Y | S | K | Y | L | D | S | Aib | Lys(C12) | Aib-# | | | | | | | | | | |
| EU-A467 | 186 | H | Aib | Q | G | T | F | T | S | D | Y | S | K | Y | L | D | S | Aib | Lys(C8) | Aib-# | | | | | | | | | | |
| EU-A468 | 187 | H | Aib | Q | G | T | F | T | S | D | Y | S | K | Y | L | D | S | Aib | Lys(C1) | Aib-# | | | | | | | | | | |
| EU-A469 | 188 | H | Aib | Q | G | T | F | T | S | D | Y | S | K | Y | L | D | S | Aib | Lys(C16) | Aib-# | | | | | | | | | | |
| EU-A470 | 189 | H | Aib | Q | G | T | F | T | S | D | Y | S | K* | Y | L | D | E* | Aib | Lys(C16) | Aib-# | | | | | | | | | | |
| EU-A471 | 190 | H | Aib | Q | G | T | F | T | S | D | Y | S | K* | Y | L | D | E* | Aib | Lys(C12) | Aib-# | | | | | | | | | | |

Figure 2 (Continued)
Table 2 (Continued)

| | SEQ. ID. NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A472 | 191 | H | Aib | Q | G | T | F | T | S | D | Y | S | K* | Y | L | D | E* | Aib | Lys(C8) | Aib-# | | | | | | | | | | |
| EU-A473 | 192 | H | Aib | Q | G | T | F | T | S | D | Y | S | K* | Y | L | D | E* | R | Lys(C16) | Aib-# | | | | | | | | | | |
| EU-A474 | 193 | H | Aib | Q | G | T | F | T | S | D | Y | S | K* | Y | L | D | E* | R | Lys(C12) | Aib-# | | | | | | | | | | |
| EU-A475 | 194 | H | Aib | Q | G | T | F | T | S | D | Y | S | K* | Y | L | D | E* | R | Lys(C8) | Aib-# | | | | | | | | | | |
| EU-A476 | 195 | H | Aib | Q | G | T | F | T | S | D | Y | S | K* | Y | L | D | E* | R | Lys(C12) | Ac5c-# | | | | | | | | | | |
| EU-A477 | 196 | H | Aib | Q | G | T | F | T | S | D | Y | S | K | Y | L | D | R | Aib | Lys(C8) | # | | | | | | | | | | |
| EU-A478 | 197 | H | Aib | Q | G | T | F | T | S | D | Y | S | K | Y | L | D | R | Aib | Lys(C12) | # | | | | | | | | | | |
| EU-A479 | 198 | H | Aib | Q | G | T | F | T | S | D | Y | S | K | Y | L | D | R | Aib | Lys(C16) | # | | | | | | | | | | |
| EU-A480 | 199 | H | Aib | Q | G | T | F | T | S | D | Y | S | K | Y | L | D | S | R | Aib | Lys(C8) | # | | | | | | | | | |
| EU-A481 | 200 | H | Aib | Q | G | T | F | T | S | D | Y | S | K | Y | L | D | S | R | Aib | Lys(C12) | # | | | | | | | | | |
| EU-A482 | 201 | H | Aib | Q | G | T | F | T | S | D | Y | S | K | Y | L | D | S | R | Aib | Lys(C16) | # | | | | | | | | | |
| EU-A483 | 202 | H | Aib | Q | G | T | F | T | S | D | Y | S | K | Y | L | D | Aib | R | Aib | Lys(C8) | # | | | | | | | | | |
| EU-A484 | 203 | H | Aib | Q | G | T | F | T | S | D | Y | S | K | Y | L | D | Aib | R | Aib | Lys(C12) | # | | | | | | | | | |
| EU-A485 | 204 | H | Aib | Q | G | T | F | T | S | D | Y | S | K | Y | L | D | Aib | R | Aib | Lys(C16) | # | | | | | | | | | |
| EU-A486 | 205 | H | Aib | Q | G | T | F | T | S | D | V | S | S | Y | L | E | R | Aib | Lys(C8) | # | | | | | | | | | | |
| EU-A487 | 206 | H | Aib | Q | G | T | F | T | S | D | V | S | S | Y | L | E | R | Aib | Lys(C12) | # | | | | | | | | | | |
| EU-A488 | 207 | H | Aib | Q | G | T | F | T | S | D | V | S | S | Y | L | E | R | Aib | Lys(C16) | # | | | | | | | | | | |
| EU-A489 | 208 | H | Aib | Q | G | T | F | T | S | D | V | S | S | Y | L | E | Aib | R | Lys(C8) | Lys(C8) | # | | | | | | | | | |
| EU-A490 | 209 | H | Aib | Q | G | T | F | T | S | D | V | S | S | Y | L | E | Aib | R | Lys(C12) | Lys(C12) | # | | | | | | | | | |
| EU-A491 | 210 | H | Aib | Q | G | T | F | T | S | D | V | S | S | Y | L | E | Aib | R | Lys(C16) | Lys(C16) | # | | | | | | | | | |
| EU-A492 | 211 | H | Aib | Q | G | T | F | T | S | D | Y | S | K | Y | L | D | hArg | Aib | Lys(C8) | # | | | | | | | | | | |
| EU-A493 | 212 | H | Aib | Q | G | T | F | T | S | D | Y | S | K | Y | L | D | hArg | Aib | Lys(C12) | # | | | | | | | | | | |
| EU-A494 | 213 | H | Aib | Q | G | T | F | T | S | D | Y | S | K | Y | L | D | hArg | Aib | Lys(C16) | # | | | | | | | | | | |
| EU-A495 | 214 | H | Aib | Q | G | T | F | T | S | D | Y | S | K | Y | L | D | Aib | hArg | Aib | Lys(C8) | # | | | | | | | | | |
| EU-A496 | 215 | H | Aib | Q | G | T | F | T | S | D | Y | S | K | Y | L | D | Aib | hArg | Aib | Lys(C12) | # | | | | | | | | | |
| EU-A497 | 216 | H | Aib | Q | G | T | F | T | S | D | Y | S | K | Y | L | D | Aib | hArg | Aib | Lys(C16) | # | | | | | | | | | |
| EU-A498 | 217 | H | Aib | Q | G | T | F | T | S | D | V | S | S | Y | L | E | hArg | Aib | Lys(C8) | # | | | | | | | | | | |
| EU-A499 | 218 | H | Aib | Q | G | T | F | T | S | D | V | S | S | Y | L | E | hArg | Aib | Lys(C12) | # | | | | | | | | | | |

Figure 2 (Continued)
Table 2 (Continued)

| | SEQ. ID. NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A501 | 219 | H | S | Q | G | T | F | T | S | D | Y | S | K | Y | L | D | S | R | R | A | Q | Lys(C12) | Aib | # | | | | | | |
| EU-A502 | 220 | H | S | Q | G | T | F | T | S | D | Y | S | K | Y | L | D | S | R | R | A | Lys(C12) | Aib | # | | | | | | | |
| EU-A503 | 221 | H | S | Q | G | T | F | T | S | D | Y | S | K | Y | L | D | S | R | R | Lys(C12) | Aib | # | | | | | | | | |
| EU-A504 | 222 | H | S | Q | G | T | F | T | S | D | Y | S | K | Y | L | D | S | R | Lys(C12) | Aib | # | | | | | | | | | |
| EU-A505 | 223 | H | S | Q | G | T | F | T | S | D | Y | S | K | Y | L | D | S | Lys(C12) | Aib | # | | | | | | | | | | |
| EU-A506 | 224 | H | S | Q | G | T | F | T | S | D | Y | S | K | Y | L | D | Lys(C12) | Aib | # | | | | | | | | | | | |
| EU-A507 | 225 | H | Aib | Q | G | T | F | T | S | D | Y | S | K | Y | L | D | E* | Q | A | A | K* | E | F | I | Lys(C12) | W | L | M | N | T# |
| EU-A509 | 226 | H | S | Q | G | T | F | T | S | D | Y | S | K | Y | L | D | S | R | R | A | Q | Lys(C12) | # | | | | | | | |
| EU-A510 | 227 | H | S | Q | G | T | F | T | S | D | Y | S | K | Y | L | D | S | R | R | A | Lys(C12) | # | | | | | | | | |
| EU-A511 | 228 | H | S | Q | G | T | F | T | S | D | Y | S | K | Y | L | D | S | R | R | Lys(C12) | # | | | | | | | | | |
| EU-A512 | 229 | H | S | Q | G | T | F | T | S | D | Y | S | K | Y | L | D | S | R | Lys(C12) | # | | | | | | | | | | |
| EU-A513 | 230 | H | S | Q | G | T | F | T | S | D | Y | S | K | Y | L | D | S | Lys(C12) | # | | | | | | | | | | | |
| EU-A514 | 231 | H | S | Q | G | T | F | T | S | D | Y | S | K | Y | L | D | Lys(C12) | # | | | | | | | | | | | | |
| EU-A515 | 232 | H | A | E | G | T | F | T | S | D | V | S | S | Y | L | E | G | Q | A | A | Lys(C12) | Aib | # | | | | | | | |
| EU-A516 | 233 | H | A | E | G | T | F | T | S | D | V | S | S | Y | L | E | G | Q | A | Lys(C12) | Aib | # | | | | | | | | |
| EU-A517 | 234 | H | A | E | G | T | F | T | S | D | V | S | S | Y | L | E | G | Q | Lys(C12) | Aib | # | | | | | | | | | |
| EU-A518 | 235 | H | A | E | G | T | F | T | S | D | V | S | S | Y | L | E | G | Lys(C12) | Aib | # | | | | | | | | | | |
| EU-A519 | 236 | H | A | E | G | T | F | T | S | D | V | S | S | Y | L | E | Lys(C12) | Aib | # | | | | | | | | | | | |
| EU-A520 | 237 | H | A | E | G | T | F | T | S | D | V | S | S | Y | L | Lys(C12) | Aib | # | | | | | | | | | | | | |
| EU-A521 | 238 | H | Aib | Q | G | T | F | T | S | D | Y | S | K | Y | L | D | Lys(C12) | Aib | # | | | | | | | | | | | |
| EU-A522 | 239 | H | Aib | Q | G | T | F | T | S | D | Y | S | K | Y | L | D | Lys(C12) | Ac4c | # | | | | | | | | | | | |
| EU-A523 | 240 | H | Aib | Q | G | T | F | T | S | D | Y | S | K | Y | L | D | Lys(C12) | R | R | Aib | # | | | | | | | | | |
| EU-A524 | 241 | H | Aib | Q | G | T | F | T | S | D | Y | S | K | Y | L | D | Lys(C12) | Aib | R | # | | | | | | | | | | |
| EU-A525 | 242 | H | Aib | Q | G | T | F | T | S | D | Y | S | K | Y | L | D | Lys(C12) | R | Aib | # | | | | | | | | | | |
| EU-A526 | 243 | H | Aib | Q | G | T | F | T | S | D | Y | S | K | Y | L | D | Lys(C12) | hArg | Aib | # | | | | | | | | | | |
| EU-A527 | 244 | H | Aib | Q | G | T | F | T | S | D | Y | S | K | Y | L | D | S | Lys(C12) | Aib | # | | | | | | | | | | |
| EU-A528 | 245 | H | Aib | Q | G | T | F | T | S | D | Y | S | K | Y | L | D | S | Lys(C12) | Ac4c | # | | | | | | | | | | |
| EU-A529 | 246 | H | Aib | Q | G | T | F | T | S | D | Y | S | K | Y | L | D | S | Lys(C12) | R | Aib | # | | | | | | | | | |
| EU-A530 | 247 | H | Aib | Q | G | T | F | T | S | D | Y | S | K | Y | L | D | S | Lys(C12) | hArg | Aib | # | | | | | | | | | |
| EU-A531 | 248 | H | Aib | Q | G | T | F | T | S | D | Y | S | K | Y | L | D | S | R | Lys(C12) | Aib | # | | | | | | | | | |

Figure 2 (Continued)
Table 2 (Continued)

| | SEQ. ID. NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A532 | 249 | H | Aib | Q | G | T | F | T | S | D | Y | S | K | Y | L | D | S | R | Lys(C12) | Ac4c | # | | | | | | | | | |
| EU-A533 | 250 | H | Aib | Q | G | T | F | T | S | D | Y | S | K | Y | L | D | S | hArg | Lys(C12) | Aib | # | | | | | | | | | |
| EU-A534 | 251 | H | Aib | Q | G | T | F | T | S | D | Y | S | K | Y | L | D | Aib | R | Lys(C12) | Aib | # | | | | | | | | | |
| EU-A535 | 252 | H | Aib | Q | G | T | F | T | S | D | Y | S | K | Y | L | D | S | R | Lys(C14) | Aib | # | | | | | | | | | |
| EU-A536 | 253 | H | Aib | Q | G | T | F | T | S | D | Y | S | K | Y | L | D | S | R | Lys(C16) | Aib | # | | | | | | | | | |
| EU-A537 | 254 | H | Aib | Q | G | T | F | T | S | D | Y | S | K | Y | L | D | S | R | Lys(C18) | Aib | # | | | | | | | | | |
| EU-A538 | 255 | H | Aib | Q | G | T | F | T | S | D | Y | S | K | Y | L | D | Aib | Q | Lys(C12) | Aib | # | | | | | | | | | |
| EU-A539 | 256 | H | Aib | Q | G | T | F | T | S | D | Y | S | K | Y | L | D | E* | Q | Lys(C12) | A | K* | # | | | | | | | | |
| EU-A540 | 257 | H | Aib | Q | G | T | F | T | S | D | Y | S | K | Y | L | D | E* | Q | Lys(C14) | A | K* | # | | | | | | | | |
| EU-A541 | 258 | H | Aib | Q | G | T | F | T | S | D | Y | S | K | Y | L | D | E* | Q | Lys(C16) | A | K* | # | | | | | | | | |
| EU-A542 | 259 | H | Aib | Q | G | T | F | T | S | D | Y | S | K | Y | L | D | E* | Q | Lys(C18) | A | K* | # | | | | | | | | |
| EU-A543 | 260 | H | Aib | Q | G | T | F | T | S | D | Y | S | K | Y | L | D | E* | Q | Lys(C20) | A | K* | # | | | | | | | | |
| EU-A544 | 261 | H | Aib | Q | G | T | F | T | S | D | Y | S | K | Y | L | D | S | R | Lys(C12) | Aib | Aib | # | | | | | | | | |
| EU-A545 | 262 | H | Aib | Q | G | T | F | T | S | D | Y | S | K | Y | L | D | S | R | Lys(C14) | Aib | Aib | # | | | | | | | | |
| EU-A546 | 263 | H | Aib | Q | G | T | F | T | S | D | Y | S | K | Y | L | D | S | R | Lys(C16) | Aib | Aib | # | | | | | | | | |
| EU-A547 | 264 | H | Aib | Q | G | T | F | T | S | D | Y | S | K | Y | L | D | S | R | Lys(C18) | Aib | Aib | # | | | | | | | | |
| EU-A548 | 265 | H | Aib | Q | G | T | F | T | S | D | Y | S | K | Y | L | D | S | R | Lys(C20) | Aib | Aib | # | | | | | | | | |
| EU-A549 | 267 | H | Aib | Q | G | T | F | T | S | D | Y | S | K | Y | L | D | Aib | Aib | Lys(C12) | # | | | | | | | | | | |
| EU-A550 | 268 | H | Aib | Q | G | T | F | T | S | D | Y | S | K | Y | L | D | Aib | Aib | Lys(C14) | # | | | | | | | | | | |
| EU-A551 | 269 | H | Aib | Q | G | T | F | T | S | D | Y | S | K | Y | L | D | Aib | Aib | Lys(C16) | # | | | | | | | | | | |
| EU-A552 | 270 | H | Aib | Q | G | T | F | T | S | D | Y | S | K | Y | L | D | Aib | Aib | Lys(C18) | # | | | | | | | | | | |
| EU-A553 | 271 | H | Aib | Q | G | T | F | T | S | D | Y | S | K | Y | L | D | Aib | Aib | Lys(C20) | # | | | | | | | | | | |
| EU-A554 | 272 | H | Aib | Q | G | T | F | T | S | D | Y | S | K | Y | L | D | S | Aib | Lys(C12) | Aib | Aib | # | | | | | | | | |
| EU-A555 | 273 | H | Aib | Q | G | T | F | T | S | D | Y | S | K | Y | L | D | S | Aib | Lys(C14) | Aib | Aib | # | | | | | | | | |
| EU-A556 | 274 | H | Aib | Q | G | T | F | T | S | D | Y | S | K | Y | L | D | S | Aib | Lys(C16) | Aib | Aib | # | | | | | | | | |
| EU-A557 | 275 | H | Aib | Q | G | T | F | T | S | D | Y | S | K | Y | L | D | S | Aib | Lys(C18) | Aib | Aib | # | | | | | | | | |
| EU-A558 | 276 | H | Aib | Q | G | T | F | T | S | D | Y | S | K | Y | L | D | S | Aib | Lys(C20) | Aib | Aib | # | | | | | | | | |
| EU-A559 | 277 | H | Aib | Q | G | T | F | T | S | D | Y | S | K | Y | L | D | S | Aib | Lys(C22) | Aib | Aib | # | | | | | | | | |
| EU-A560 | 278 | H | Aib | Q | G | T | F | T | S | D | Y | S | K* | Y | L | D | E* | R | Lys(C12) | Aib | # | | | | | | | | | |
| EU-A561 | 279 | H | Aib | Q | G | T | F | T | S | D | Y | S | K* | Y | L | D | E* | R | Lys(C14) | Aib | # | | | | | | | | | |
| EU-A562 | 280 | H | Aib | Q | G | T | F | T | S | D | Y | S | K* | Y | L | D | E* | R | Lys(C16) | Aib | # | | | | | | | | | |
| EU-A563 | 281 | H | Aib | Q | G | T | F | T | S | D | Y | S | K* | Y | L | D | E* | R | Lys(C18) | Aib | # | | | | | | | | | |
| EU-A564 | 282 | H | Aib | Q | G | T | F | T | S | D | Y | S | K* | Y | L | D | E* | R | Lys(C20) | Aib | # | | | | | | | | | |
| EU-A565 | 283 | H | Aib | Q | G | T | F | T | S | D | Y | S | K* | Y | L | D | E* | Q | Lys(C12) | Aib | # | | | | | | | | | |

Figure 2 (Continued)
Table 2 (Continued)

| | SEQ. ID. NO. | 1 | | | | 5 | | | | | 10 | | | | | 15 | | | | | 20 | | | | | 25 | | | | |
|---|---|---|---|---|---|---|---|---|---|---|---|---|---|---|---|---|---|---|---|---|---|---|---|---|---|---|---|---|---|---|
| EU-A566 | 284 | H | Aib | Q | G | T | F | T | S | D | Y | S | K* | Y | L | D | E* | Q | Lys(C14) | Aib | # | | | | | | | | | |
| EU-A567 | 285 | H | Aib | Q | G | T | F | T | S | D | Y | S | K* | Y | L | D | E* | Q | Lys(C16) | Aib | # | | | | | | | | | |
| EU-A568 | 286 | H | Aib | Q | G | T | F | T | S | D | Y | S | K* | Y | L | D | E* | Q | Lys(C18) | Aib | # | | | | | | | | | |
| EU-A569 | 287 | H | Aib | Q | G | T | F | T | S | D | Y | S | K* | Y | L | D | E* | Q | Lys(C20) | Aib | # | | | | | | | | | |
| EU-A570 | 288 | H | Aib | Q | G | T | F | T | S | D | Y | S | E* | Y | L | D | K* | R | Lys(C12) | Aib | Aib | # | | | | | | | | |
| EU-A571 | 289 | H | Aib | Q | G | T | F | T | S | D | Y | S | E* | Y | L | D | K* | R | Lys(C14) | Aib | Aib | # | | | | | | | | |
| EU-A572 | 290 | H | Aib | Q | G | T | F | T | S | D | Y | S | E* | Y | L | D | K* | R | Lys(C16) | Aib | Aib | # | | | | | | | | |
| EU-A573 | 291 | H | Aib | Q | G | T | F | T | S | D | Y | S | E* | Y | L | D | K* | R | Lys(C18) | Aib | Aib | # | | | | | | | | |
| EU-A574 | 292 | H | Aib | Q | G | T | F | T | S | D | Y | S | E* | Y | L | D | K* | R | Lys(C20) | Aib | Aib | # | | | | | | | | |
| EU-A575 | 293 | H | Aib | Q | G | T | F | T | S | D | Y | S | E* | Y | L | D | K* | hArg | Lys(C12) | Aib | Aib | # | | | | | | | | |
| EU-A576 | 294 | H | Aib | Q | G | T | F | T | S | D | Y | S | E* | Y | L | D | K* | hArg | Lys(C14) | Aib | Aib | # | | | | | | | | |
| EU-A577 | 295 | H | Aib | Q | G | T | F | T | S | D | Y | S | E* | Y | L | D | K* | hArg | Lys(C16) | Aib | Aib | # | | | | | | | | |
| EU-A578 | 296 | H | Aib | Q | G | T | F | T | S | D | Y | S | E* | Y | L | D | K* | hArg | Lys(C18) | Aib | Aib | # | | | | | | | | |
| EU-A579 | 297 | H | Aib | Q | G | T | F | T | S | D | Y | S | E* | Y | L | D | K* | hArg | Lys(C20) | Aib | Aib | # | | | | | | | | |
| EU-A580 | 298 | H | Ac4c | Q | G | T | F | T | S | D | Y | S | K* | Y | L | D | E* | R | Lys(C12) | Aib | Aib | # | | | | | | | | |
| EU-A581 | 299 | H | Ac4c | Q | G | T | F | T | S | D | Y | S | K* | Y | L | D | E* | R | Lys(C14) | Aib | Aib | # | | | | | | | | |
| EU-A582 | 300 | H | Ac4c | Q | G | T | F | T | S | D | Y | S | K* | Y | L | D | E* | R | Lys(C16) | Aib | Aib | # | | | | | | | | |
| EU-A583 | 301 | H | Ac4c | Q | G | T | F | T | S | D | Y | S | K* | Y | L | D | E* | R | Lys(C18) | Aib | Aib | # | | | | | | | | |
| EU-A584 | 302 | H | Ac4c | Q | G | T | F | T | S | D | Y | S | K* | Y | L | D | E* | R | Lys(C20) | Aib | Aib | # | | | | | | | | |
| EU-A585 | 303 | H | Ac4c | Q | G | T | F | T | S | D | Y | S | K* | Y | L | D | E* | hArg | Lys(C12) | Aib | Aib | # | | | | | | | | |
| EU-A586 | 304 | H | Ac4c | Q | G | T | F | T | S | D | Y | S | K* | Y | L | D | E* | hArg | Lys(C14) | Aib | Aib | # | | | | | | | | |
| EU-A587 | 305 | H | Ac4c | Q | G | T | F | T | S | D | Y | S | K* | Y | L | D | E* | hArg | Lys(C16) | Aib | Aib | # | | | | | | | | |
| EU-A588 | 306 | H | Ac4c | Q | G | T | F | T | S | D | Y | S | K* | Y | L | D | E* | hArg | Lys(C18) | Aib | Aib | # | | | | | | | | |
| EU-A589 | 307 | H | Ac4c | Q | G | T | F | T | S | D | Y | S | K* | Y | L | D | E* | hArg | Lys(C20) | Aib | Aib | # | | | | | | | | |
| EU-A590 | 308 | H | Ac4c | Q | G | T | F | T | S | D | Y | S | E* | Y | L | D | K* | R | Lys(C12) | Aib | Aib | # | | | | | | | | |
| EU-A591 | 309 | H | Ac4c | Q | G | T | F | T | S | D | Y | S | E* | Y | L | D | K* | R | Lys(C14) | Aib | Aib | # | | | | | | | | |
| EU-A592 | 310 | H | Ac4c | Q | G | T | F | T | S | D | Y | S | E* | Y | L | D | K* | R | Lys(C16) | Aib | Aib | # | | | | | | | | |
| EU-A593 | 311 | H | Ac4c | Q | G | T | F | T | S | D | Y | S | E* | Y | L | D | K* | R | Lys(C18) | Aib | Aib | # | | | | | | | | |
| EU-A594 | 312 | H | Ac4c | Q | G | T | F | T | S | D | Y | S | E* | Y | L | D | K* | R | Lys(C20) | Aib | Aib | # | | | | | | | | |
| EU-A595 | 313 | H | Ac4c | Q | G | T | F | T | S | D | Y | S | E* | Y | L | D | K* | hArg | Lys(C12) | Aib | Aib | # | | | | | | | | |
| EU-A596 | 314 | H | Ac4c | Q | G | T | F | T | S | D | Y | S | E* | Y | L | D | K* | hArg | Lys(C14) | Aib | Aib | # | | | | | | | | |
| EU-A597 | 315 | H | Ac4c | Q | G | T | F | T | S | D | Y | S | E* | Y | L | D | K* | hArg | Lys(C16) | Aib | Aib | # | | | | | | | | |
| EU-A598 | 316 | H | Ac4c | Q | G | T | F | T | S | D | Y | S | E* | Y | L | D | K* | hArg | Lys(C18) | Aib | Aib | # | | | | | | | | |
| EU-A599 | 317 | H | Ac4c | Q | G | T | F | T | S | D | Y | S | E* | Y | L | D | K* | hArg | Lys(C20) | Aib | Aib | # | | | | | | | | |

Figure 2 (Continued)
Table 2 (Continued)

MeF means C-alphaMe-Phe.

Lys(C12) means N-epsilon-(1'-dodecyl beta-D-glucuronyl)-L-lysine and other C numbers mean the corresponding 1'-alkyl glucoronide. The pair of amino acids E*, K* or K*, E* separated by 4 residues denotes a side chain lactam linkage formed between the side chain functional groups on these amino acids.

# means amide C-terminus.

Figure 3

Table 3

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A700 | 318 | H | Aib | Q | G | T | F | T | S | D | Y | S | K | Y | L | D | Aib | R | Lys(C12) | Aib | Aib | # | | | | | | | | | |
| EU-A701 | 319 | H | Aib | Q | G | T | F | T | S | D | Y | S | K | Y | L | D | Aib | R | Lys(C14) | Aib | Aib | # | | | | | | | | | |
| EU-A702 | 320 | H | Aib | Q | G | T | F | T | S | D | Y | S | K | Y | L | D | Aib | R | Lys(C16) | Aib | Aib | # | | | | | | | | | |
| EU-A703 | 321 | H | Aib | Q | G | T | F | T | S | D | Y | S | K | Y | L | D | Aib | R | Lys(C18) | Aib | Aib | # | | | | | | | | | |
| EU-A704 | 322 | H | Aib | Q | G | T | F | T | S | D | Y | S | K | Y | L | D | Aib | R | Lys(C20) | Aib | Aib | # | | | | | | | | | |
| EU-A705 | 323 | H | Aib | Q | G | T | F | T | S | D | Y | S | K | Y | L | D | Aib | hArg | Lys(C12) | Aib | Aib | # | | | | | | | | | |
| EU-A706 | 324 | H | Aib | Q | G | T | F | T | S | D | Y | S | K | Y | L | D | Aib | hArg | Lys(C14) | Aib | Aib | # | | | | | | | | | |
| EU-A707 | 325 | H | Aib | Q | G | T | F | T | S | D | Y | S | K | Y | L | D | Aib | hArg | Lys(C16) | Aib | Aib | # | | | | | | | | | |
| EU-A708 | 326 | H | Aib | Q | G | T | F | T | S | D | Y | S | K | Y | L | D | Aib | hArg | Lys(C18) | Aib | Aib | # | | | | | | | | | |
| EU-A709 | 327 | H | Aib | Q | G | T | F | T | S | D | Y | S | K | Y | L | D | Aib | hArg | Lys(C20) | Aib | Aib | # | | | | | | | | | |
| EU-A710 | 328 | H | Aib | Q | G | T | F | T | S | D | Y | S | K | Y | L | D | Aib | R | Lys(C12) | Aib | # | | | | | | | | | | |
| EU-A711 | 329 | H | Aib | Q | G | T | F | T | S | D | Y | S | K | Y | L | D | Aib | R | Lys(C14) | Aib | # | | | | | | | | | | |
| EU-A712 | 330 | H | Aib | Q | G | T | F | T | S | D | Y | S | K | Y | L | D | Aib | R | Lys(C16) | Aib | # | | | | | | | | | | |
| EU-A713 | 331 | H | Aib | Q | G | T | F | T | S | D | Y | S | K | Y | L | D | Aib | R | Lys(C18) | Aib | # | | | | | | | | | | |
| EU-A714 | 332 | H | Aib | Q | G | T | F | T | S | D | Y | S | K | Y | L | D | Aib | R | Lys(C20) | Aib | # | | | | | | | | | | |
| EU-A715 | 333 | H | Aib | Q | G | T | F | T | S | D | Y | S | K | Y | L | D | Aib | hArg | Lys(C12) | Aib | # | | | | | | | | | | |
| EU-A716 | 334 | H | Aib | Q | G | T | F | T | S | D | Y | S | K | Y | L | D | Aib | hArg | Lys(C14) | Aib | # | | | | | | | | | | |
| EU-A717 | 335 | H | Aib | Q | G | T | F | T | S | D | Y | S | K | Y | L | D | Aib | hArg | Lys(C16) | Aib | # | | | | | | | | | | |
| EU-A718 | 336 | H | Aib | Q | G | T | F | T | S | D | Y | S | K | Y | L | D | Aib | hArg | Lys(C18) | Aib | # | | | | | | | | | | |
| EU-A719 | 337 | H | Aib | Q | G | T | F | T | S | D | Y | S | K | Y | L | D | Aib | hArg | Lys(C20) | Aib | # | | | | | | | | | | |
| EU-A720 | 338 | H | Ac3c | Q | G | T | F | T | S | D | Y | S | K | Y | L | D | Aib | hArg | Lys(C12) | Aib | # | | | | | | | | | | |
| EU-A721 | 339 | H | Aib | Q | G | T | F | T | S | D | Y | S | K | Y | L | D | S | Arg | Lys(C12) | # | | | | | | | | | | | |
| EU-A722 | 340 | H | Aib | Q | G | T | F | T | S | D | Y | S | K | Y | L | D | S | hArg | Lys(C12) | # | | | | | | | | | | | |
| EU-A723 | 341 | H | Aib | Q | G | T | F | T | S | D | Y | S | K | Y | L | D | Aib | Arg | Lys(C12) | # | | | | | | | | | | | |
| EU-A724 | 342 | H | Aib | Q | G | T | F | T | S | D | Y | S | K | Y | L | D | Aib | hArg | Lys(C12) | # | | | | | | | | | | | |
| EU-A725 | 343 | H | Ac4c | Q | G | T | F | T | S | D | Y | S | K | Y | L | D | Aib | Arg | Lys(C12) | # | | | | | | | | | | | |
| EU-A726 | 344 | H | Ac4c | Q | G | T | F | T | S | D | Y | S | K | Y | L | D | Aib | Arg | Lys(C12) | Aib | # | | | | | | | | | | |
| EU-A727 | 345 | H | Ac4c | Q | G | T | F | T | S | D | Y | S | K | Y | L | D | Aib | hArg | Lys(C12) | # | | | | | | | | | | | |
| EU-A728 | 346 | H | Ac4c | Q | G | T | F | T | S | D | Y | S | K | Y | L | D | Aib | hArg | Lys(C14) | # | | | | | | | | | | | |
| EU-A729 | 347 | H | Ac4c | Q | G | T | F | T | S | D | Y | S | K | Y | L | D | Aib | hArg | Lys(C16) | # | | | | | | | | | | | |
| EU-A730 | 348 | H | Ac4c | Q | G | T | F | T | S | D | Y | S | K | Y | L | D | Aib | hArg | Lys(C18) | # | | | | | | | | | | | |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A731 | 349 | H | Aib | Q | G | T | F | T | S | D | E* | S | K | Y | K* | D | S | Arg | Lys(C12) | # | | | | | | | | | | | |
| EU-A732 | 350 | H | Ac4c | Q | G | T | F | T | S | D | E* | S | K | Y | K* | D | Aib | hArg | Lys(C14) | # | | | | | | | | | | | |
| EU-A733 | 351 | H | Aib | Q | G | T | F | T | S | D | Y | S | K | E* | L | D | S | K* | Lys(C12) | # | | | | | | | | | | | |
| EU-A734 | 352 | H | Aib | Q | G | T | F | T | S | D | Y | S | K | Y | L | D | S | E* | Lys(C12) | A | K* | # | | | | | | | | | |
| EU-A735 | 353 | H | Aib | Q | G | T | F | T | S | D | Y | S | K | Y | L | D | S | E* | Lys(C12) | A | R | K*-# | | | | | | | | | |
| EU-A736 | 354 | H | Aib | Q | G | T | F | T | S | D | Y | S | K | Y | L | D | S | E* | Lys(C14) | A | R | K*-# | | | | | | | | | |
| EU-A737 | 355 | H | Aib | Q | G | T | F | T | S | D | Y | S | K | Y | L | D | S | E* | Lys(C16) | A | R | K*-# | | | | | | | | | |
| EU-A738 | 356 | H | Aib | Q | G | T | F | T | S | D | Y | S | K | Y | L | D | S | E* | Lys(C18) | A | R | K*-# | | | | | | | | | |
| EU-A739 | 357 | H | Aib | Q | G | T | F | T | S | D | Y | S | K | Y | L | D | S | E* | Lys(C20) | A | R | K*-# | | | | | | | | | |
| EU-A740 | 358 | H | Aib | Q | G | T | F | T | S | D | Y | S | K | Y | L | D | S | E* | Lys(C12) | A | Q | K*-# | | | | | | | | | |
| EU-A741 | 359 | H | Aib | Q | G | T | F | T | S | D | Y | S | K | Y | L | D | S | E* | Lys(C14) | A | Q | K*-# | | | | | | | | | |
| EU-A742 | 360 | H | Aib | Q | G | T | F | T | S | D | Y | S | K | Y | L | D | S | E* | Lys(C16) | A | Q | K*-# | | | | | | | | | |
| EU-A743 | 361 | H | Aib | Q | G | T | F | T | S | D | Y | S | K | Y | L | D | S | E* | Lys(C18) | A | Q | K*-# | | | | | | | | | |
| EU-A744 | 362 | H | Aib | Q | G | T | F | T | S | D | Y | S | K | Y | L | D | S | E* | Lys(C20) | A | Q | K*-# | | | | | | | | | |
| EU-A745 | 363 | H | Aib | Q | G | T | F | T | S | D | Y | S | K | Y | L | D | S | E* | Lys(C12) | V | R | K*-# | | | | | | | | | |
| EU-A746 | 364 | H | Aib | Q | G | T | αMeF | T | S | D | Y | Lys(C8) | # | | | | | | | | | | | | | | | | | | |
| EU-A747 | 365 | H | Aib | Q | G | T | αMeF | T | S | D | Y | Lys(C14) | # | | | | | | | | | | | | | | | | | | |
| EU-A748 | 366 | H | Aib | Q | G | T | αMeF | T | S | D | Y | Lys(C16) | # | | | | | | | | | | | | | | | | | | |
| EU-A749 | 367 | H | Aib | Q | G | T | αMeF | T | S | D | Y | Lys(C20) | # | | | | | | | | | | | | | | | | | | |
| EU-A750 | 368 | H | Aib | Q | G | T | F | T | S | D | Y | Lys(C12) | # | | | | | | | | | | | | | | | | | | |
| EU-A751 | 369 | H | Aib | Q | G | T | αMeF | T | S | D | Y | Lys(C12) | # | | | | | | | | | | | | | | | | | | |
| EU-A752 | 370 | H | Aib | Q | G | T | αMeF | T | S | D | Y | Lys(C18) | # | | | | | | | | | | | | | | | | | | |
| EU-A753 | 371 | H | αMePro | Q | G | T | F | T | S | D | Y | Lys(C12) | # | | | | | | | | | | | | | | | | | | |
| EU-A754 | 372 | H | αMePro | Q | G | T | αMeF | T | S | D | Y | Lys(C12) | # | | | | | | | | | | | | | | | | | | |
| EU-A755 | 373 | H | αMePro | Q | G | T | αMeF | T | S | D | Bip | Lys(C12) | # | | | | | | | | | | | | | | | | | | |
| EU-A756 | 374 | H | Aib | Q | G | T | F | T | S | D | Bip | Lys(C12) | # | | | | | | | | | | | | | | | | | | |
| EU-A757 | 375 | H | Aib | Q | G | T | αMeF | T | S | D | Bip | Lys(C18) | # | | | | | | | | | | | | | | | | | | |
| EU-A758 | 376 | H | αMePro | Q | G | T | αMeF | T | S | D | Y | Lys(C8) | # | | | | | | | | | | | | | | | | | | |
| EU-A759 | 377 | H | αMePro | Q | G | T | αMeF | T | S | D | Y | Lys(16) | # | | | | | | | | | | | | | | | | | | |
| EU-A760 | 378 | H | G | Q | G | T | F | T | S | D | Y | S | K | Y | L | D | E | Lys(C8) | A | A | R | E | F | I | A | W | L | L | N | T | # |
| EU-A761 | 379 | H | G | Q | G | T | F | T | S | D | Y | S | K | Y | L | D | E | Lys(C12) | A | A | R | E | F | I | A | W | L | L | N | T | # |
| EU-A762 | 380 | H | G | Q | G | T | F | T | S | D | Y | S | K | Y | L | D | E | Lys(C14) | A | A | R | E | F | I | A | W | L | L | N | T | # |
| EU-A763 | 381 | H | G | Q | G | T | F | T | S | D | Y | S | K | Y | L | D | E | Lys(C16) | A | A | R | E | F | I | A | W | L | L | N | T | # |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A764 | 382 | H | G | Q | G | T | F | T | S | D | Y | S | K | Y | L | D | E | Lys(C18) | A | A | R | E | F | I | A | W | L | L | N | T | # |
| EU-A765 | 383 | H | G | Q | G | T | F | T | S | D | Y | S | K | Y | L | D | E | Lys(C20) | A | A | R | E | F | I | A | W | L | L | N | T | # |
| EU-A766 | 384 | H | G | Q | G | T | F | T | S | D | Y | S | K | Y | L | D | E | Lys(C8) | A | A | K | E | F | I | A | W | L | L | N | T | # |
| EU-A767 | 385 | H | G | Q | G | T | F | T | S | D | Y | S | K | Y | L | D | E | Lys(C14) | A | A | K | E | F | I | A | W | L | L | N | T | # |
| EU-A768 | 386 | H | G | Q | G | T | F | T | S | D | Y | S | K | Y | L | D | E | Lys(C16) | A | A | K | E | F | I | A | W | L | L | N | T | # |
| EU-A769 | 387 | H | G | Q | G | T | F | T | S | D | Y | S | K | Y | L | D | E | Lys(C20) | A | A | K | E | F | I | A | W | L | L | N | T | # |
| EU-A770 | 388 | H | G | Q | G | T | F | T | S | D | Y | S | K | Y | L | D | E | K | A | A | K | E | F | I | A | W | L | L | N | T | # |
| EU-A771 | 389 | H | G | Q | G | T | F | T | S | D | Y | S | K | Y | L | D | E | Lys(C12) | A | A | K | E | F | I | A | W | L | L | N | T | # |
| EU-A772 | 390 | H | G | Q | G | T | F | T | S | D | Y | S | K | Y | L | D | E | Lys(C18) | A | A | K | E | F | I | A | W | L | L | N | T | # |
| EU-A773 | 391 | H | Aib | Q | G | T | F | T | S | D | Y | S | K | Y | L | D | E | Lys(C18) | A | A | K | E | F | I | A | W | L | L | N | T | # |
| EU-A774 | 392 | H | G | Q | G | T | F | T | S | D | Y | S | K | Y | L | D | E | R | R | A | K | D | F | V | Q | W | L | L | N | T | # |
| EU-A775 | 393 | H | G | Q | G | T | F | T | S | D | Y | S | K | Y | L | D | E | R | R | A | Lys(C12) | D | F | V | Q | W | L | L | N | T | # |
| EU-A776 | 394 | H | G | Q | G | T | F | T | S | D | Y | S | K | Y | L | D | E | R | R | A | Lys(C18) | D | F | V | Q | W | L | L | N | T | # |
| EU-A777 | 395 | H | Aib | Q | G | T | F | T | S | D | Y | S | K | Y | L | D | E | R | R | A | Lys(C18) | D | F | V | Q | W | L | L | N | T | # |
| EU-A778 | 396 | H | Aib | Q | G | T | F | T | S | D | Y | S | K | Y | L | D | E | R | R | A | Lys(C8) | D | F | V | Q | W | L | L | N | T | # |
| EU-A779 | 397 | H | Aib | Q | G | T | F | T | S | D | Y | S | K | Y | L | D | E | R | R | A | Lys(C12) | D | F | V | Q | W | L | L | N | T | # |
| EU-A780 | 398 | H | Aib | Q | G | T | F | T | S | D | Y | S | K | Y | L | D | E | R | R | A | Lys(C14) | D | F | V | Q | W | L | L | N | T | # |
| EU-A781 | 399 | H | Aib | Q | G | T | F | T | S | D | Y | S | K | Y | L | D | E | R | R | A | Lys(C16) | D | F | V | Q | W | L | L | N | T | # |
| EU-A782 | 400 | H | Aib | Q | G | T | F | T | S | D | Y | S | K | Y | L | D | E | R | R | A | Lys(C18) | D | F | V | Q | W | L | L | N | T | # |
| EU-A783 | 401 | H | Aib | Q | G | T | F | T | S | D | Y | S | K | Y | L | D | E | R | R | A | Lys(C20) | D | F | V | Q | W | L | L | N | T | # |
| EU-A784 | 402 | H | G | Q | G | T | F | T | S | D | Y | S | K | Y | L | D | E | R | R | A | Lys(C8) | D | F | V | Q | W | L | L | N | T | # |
| EU-A785 | 403 | H | G | Q | G | T | F | T | S | D | Y | S | K | Y | L | D | E | R | R | A | Lys(C12) | D | F | V | Q | W | L | L | N | T | # |
| EU-A786 | 404 | H | G | Q | G | T | F | T | S | D | Y | S | K | Y | L | D | E | R | R | A | Lys(C14) | D | F | V | Q | W | L | L | N | T | # |
| EU-A787 | 405 | H | G | Q | G | T | F | T | S | D | Y | S | K | Y | L | D | E | R | R | A | Lys(C16) | D | F | V | Q | W | L | L | N | T | # |
| EU-A788 | 406 | H | G | Q | G | T | F | T | S | D | Y | S | K | Y | L | D | E | R | R | A | Lys(C18) | D | F | V | Q | W | L | L | N | T | # |
| EU-A789 | 407 | H | G | Q | G | T | F | T | S | D | Y | S | K | Y | L | D | E | R | R | A | Lys(C20) | D | F | V | Q | W | L | L | N | T | # |
| EU-A790 | 408 | H | Aib | Q | G | T | F | T | S | D | Y | S | K | Y | L | D | E | Lys(C8) | A | A | K | E | F | I | A | W | L | L | N | T | # |
| EU-A791 | 409 | H | Aib | Q | G | T | F | T | S | D | Y | S | K | Y | L | D | E | Lys(C12) | A | A | K | E | F | I | A | W | L | L | N | T | # |
| EU-A792 | 410 | H | Aib | Q | G | T | F | T | S | D | Y | S | K | Y | L | D | E | Lys(C14) | A | A | K | E | F | I | A | W | L | L | N | T | # |
| EU-A793 | 411 | H | Aib | Q | G | T | F | T | S | D | Y | S | K | Y | L | D | E | Lys(C16) | A | A | K | E | F | I | A | W | L | L | N | T | # |
| EU-A794 | 412 | H | Aib | Q | G | T | F | T | S | D | Y | S | K | Y | L | D | E | Lys(C18) | A | A | K | E | F | I | A | W | L | L | N | T | # |
| EU-A795 | 413 | H | Aib | Q | G | T | F | T | S | D | Y | S | K | Y | L | D | E | Lys(C20) | A | A | K | E | F | I | A | W | L | L | N | T | # |
| EU-A796 | 414 | H | Aib | Q | G | T | F | T | S | D | Y | S | K | Y | L | D | E* | Q | A | A | K* | E | F | I | Lys(C8) | W | L | M | N | T | # |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A797 | 415 | H | Aib | Q | G | T | F | T | S | D | Y | S | K | Y | L | D | E* | Q | A | A | K* | E | F | I | Lys(C12) | W | L | M | N | T | # |
| EU-A798 | 416 | H | Aib | Q | G | T | F | T | S | D | Y | S | K | Y | L | D | E* | Q | A | A | K* | E | F | I | Lys(C14) | W | L | M | N | T | # |
| EU-A799 | 417 | H | Aib | Q | G | T | F | T | S | D | Y | S | K | Y | L | D | E* | Q | A | A | K* | E | F | I | Lys(C16) | W | L | M | N | T | # |
| EU-A800 | 418 | H | Aib | Q | G | T | F | T | S | D | Y | S | K | Y | L | D | E* | Q | A | A | K* | E | F | I | Lys(C18) | W | L | M | N | T | # |
| EU-A801 | 419 | H | Aib | Q | G | T | F | T | S | D | Y | S | K | Y | L | D | E* | Q | A | A | K* | E | F | I | Lys(C20) | W | L | M | N | T | # |
| EU-A802 | 420 | H | Aib | Q | G | T | F | T | S | D | Y | S | K | Y | L | D | E* | Q | A | A | K* | E | F | I | Lys(C8) | W | L | L | N | T | # |
| EU-A803 | 421 | H | Aib | Q | G | T | F | T | S | D | Y | S | K | Y | L | D | E* | Q | A | A | K* | E | F | I | Lys(C12) | W | L | L | N | T | # |
| EU-A804 | 422 | H | Aib | Q | G | T | F | T | S | D | Y | S | K | Y | L | D | E* | Q | A | A | K* | E | F | I | Lys(C14) | W | L | L | N | T | # |
| EU-A805 | 423 | H | Aib | Q | G | T | F | T | S | D | Y | S | K | Y | L | D | E* | Q | A | A | K* | E | F | I | Lys(C16) | W | L | L | N | T | # |
| EU-A806 | 424 | H | Aib | Q | G | T | F | T | S | D | Y | S | K | Y | L | D | E* | Q | A | A | K* | E | F | I | Lys(C18) | W | L | L | N | T | # |
| EU-A807 | 425 | H | Aib | Q | G | T | F | T | S | D | Y | S | K | Y | L | D | E* | Q | A | A | K* | E | F | I | Lys(C20) | W | L | L | N | T | # |
| EU-A808 | 426 | H | G | Q | G | T | F | T | S | D | Y | S | K | Y | L | D | E | Q | A | A | R | E | F | I | Lys(C8) | W | L | L | N | T | # |
| EU-A809 | 427 | H | G | Q | G | T | F | T | S | D | Y | S | K | Y | L | D | E | Q | A | A | R | E | F | I | Lys(C12) | W | L | L | N | T | # |
| EU-A810 | 428 | H | G | Q | G | T | F | T | S | D | Y | S | K | Y | L | D | E | Q | A | A | R | E | F | I | Lys(C14) | W | L | L | N | T | # |
| EU-A811 | 429 | H | G | Q | G | T | F | T | S | D | Y | S | K | Y | L | D | E | Q | A | A | R | E | F | I | Lys(C16) | W | L | L | N | T | # |
| EU-A812 | 430 | H | G | Q | G | T | F | T | S | D | Y | S | K | Y | L | D | E | Q | A | A | R | E | F | I | Lys(C18) | W | L | L | N | T | # |
| EU-A813 | 431 | H | G | Q | G | T | F | T | S | D | Y | S | K | Y | L | D | E | Q | A | A | R | E | F | I | Lys(C20) | W | L | L | N | T | # |
| EU-A814 | 432 | H | Aib | Q | G | T | F | T | S | D | Y | S | K | Y | L | D | E | Lys(C8) | A | A | R | E | F | I | A | W | L | L | N | T | # |
| EU-A815 | 433 | H | Aib | Q | G | T | F | T | S | D | Y | S | K | Y | L | D | E | Lys(C12) | A | A | R | E | F | I | A | W | L | L | N | T | # |
| EU-A816 | 434 | H | Aib | Q | G | T | F | T | S | D | Y | S | K | Y | L | D | E | Lys(C14) | A | A | R | E | F | I | A | W | L | L | N | T | # |
| EU-A817 | 435 | H | Aib | Q | G | T | F | T | S | D | Y | S | K | Y | L | D | E | Lys(C16) | A | A | R | E | F | I | A | W | L | L | N | T | # |
| EU-A818 | 436 | H | Aib | Q | G | T | F | T | S | D | Y | S | K | Y | L | D | E | Lys(C18) | A | A | R | E | F | I | A | W | L | L | N | T | # |
| EU-A819 | 437 | H | Aib | Q | G | T | F | T | S | D | Y | S | K | Y | L | D | E | Lys(C20) | A | A | R | E | F | I | A | W | L | L | N | T | # |
| EU-A820 | 438 | H | G | Q | G | T | F | T | S | D | Y | S | K | Y | L | D | E | R | R | A | Q | D | F | V | Lys(C8) | W | L | L | N | T | # |
| EU-A821 | 439 | H | G | Q | G | T | F | T | S | D | Y | S | K | Y | L | D | E | R | R | A | Q | D | F | V | Lys(C12) | W | L | L | N | T | # |
| EU-A822 | 440 | H | G | Q | G | T | F | T | S | D | Y | S | K | Y | L | D | E | R | R | A | Q | D | F | V | Lys(C14) | W | L | L | N | T | # |
| EU-A823 | 441 | H | G | Q | G | T | F | T | S | D | Y | S | K | Y | L | D | E | R | R | A | Q | D | F | V | Lys(C16) | W | L | L | N | T | # |
| EU-A824 | 442 | H | G | Q | G | T | F | T | S | D | Y | S | K | Y | L | D | E | R | R | A | Q | D | F | V | Lys(C18) | W | L | L | N | T | # |
| EU-A825 | 443 | H | G | Q | G | T | F | T | S | D | Y | S | K | Y | L | D | E | R | R | A | Q | D | F | V | Lys(C20) | W | L | L | N | T | # |
| EU-A826 | 444 | H | αMePro | Q | G | T | αMeF | T | S | D | Bip | Lys(C8) | # | | | | | | | | | | | | | | | | | | |
| EU-A827 | 445 | H | αMePro | Q | G | T | αMeF | T | S | D | Bip | Lys(C12) | # | | | | | | | | | | | | | | | | | | |
| EU-A828 | 446 | H | αMePro | Q | G | T | αMeF | T | S | D | Bip | Lys(C14) | # | | | | | | | | | | | | | | | | | | |
| EU-A829 | 447 | H | αMePro | Q | G | T | αMeF | T | S | D | Bip | Lys(C16) | # | | | | | | | | | | | | | | | | | | |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A830 | 448 | H | αMePro | Q | G | T | αMeF | T | S | D | Bip | Lys(C18) | # | | | | | | | | | | | | | | | | | | |
| EU-A831 | 449 | H | αMePro | Q | G | T | αMeF | T | S | D | Bip | Lys(C20) | # | | | | | | | | | | | | | | | | | | |
| EU-A832 | 450 | H | αMePro | Q | G | T | αMeFF | T | S | D | Bip | Lys(C8) | # | | | | | | | | | | | | | | | | | | |
| EU-A833 | 451 | H | αMePro | Q | G | T | αMeFF | T | S | D | Bip | Lys(C12) | # | | | | | | | | | | | | | | | | | | |
| EU-A834 | 452 | H | αMePro | Q | G | T | αMeFF | T | S | D | Bip | Lys(C14) | # | | | | | | | | | | | | | | | | | | |
| EU-A835 | 453 | H | αMePro | Q | G | T | αMeFF | T | S | D | Bip | Lys(C16) | # | | | | | | | | | | | | | | | | | | |
| EU-A836 | 454 | H | αMePro | Q | G | T | αMeFF | T | S | D | Bip | Lys(C18) | # | | | | | | | | | | | | | | | | | | |
| EU-A837 | 455 | H | αMePro | Q | G | T | αMeFF | T | S | D | Bip | Lys(C20) | # | | | | | | | | | | | | | | | | | | |
| EU-A838 | 456 | H | Aib | Q | G | T | αMeF | T | S | D | Bip | Lys(C8) | # | | | | | | | | | | | | | | | | | | |
| EU-A839 | 457 | H | Aib | Q | G | T | αMeF | T | S | D | Bip | Lys(C12) | # | | | | | | | | | | | | | | | | | | |
| EU-A840 | 458 | H | Aib | Q | G | T | αMeF | T | S | D | Bip | Lys(C14) | # | | | | | | | | | | | | | | | | | | |
| EU-A841 | 459 | H | Aib | Q | G | T | αMeF | T | S | D | Bip | Lys(C16) | # | | | | | | | | | | | | | | | | | | |
| EU-A842 | 450 | H | Aib | Q | G | T | αMeF | T | S | D | Bip | Lys(C20) | # | | | | | | | | | | | | | | | | | | |
| EU-A843 | 451 | H | Aib | Q | G | T | αMeFF | T | S | D | Bip | Lys(C8) | # | | | | | | | | | | | | | | | | | | |
| EU-A844 | 452 | H | Aib | Q | G | T | αMeFF | T | S | D | Bip | Lys(C12) | # | | | | | | | | | | | | | | | | | | |
| EU-A845 | 453 | H | Aib | Q | G | T | αMeFF | T | S | D | Bip | Lys(C14) | # | | | | | | | | | | | | | | | | | | |
| EU-A846 | 454 | H | Aib | Q | G | T | αMeFF | T | S | D | Bip | Lys(C16) | # | | | | | | | | | | | | | | | | | | |
| EU-A847 | 455 | H | Aib | Q | G | T | αMeFF | T | S | D | Bip | Lys(C18) | # | | | | | | | | | | | | | | | | | | |
| EU-A848 | 456 | H | Aib | Q | G | T | αMeFF | T | S | D | Bip | Lys(C20) | # | | | | | | | | | | | | | | | | | | |
| EU-A849 | 457 | H | G | Q | G | T | F | T | S | D | Y | S | K | Y | L | D | A | Lys(C8) | A | A | R | E | F | I | A | W | L | L | N | T | # |
| EU-A850 | 458 | H | G | Q | G | T | F | T | S | D | Y | S | K | Y | L | D | A | Lys(C12) | A | A | R | E | F | I | A | W | L | L | N | T | # |
| EU-A851 | 459 | H | G | Q | G | T | F | T | S | D | Y | S | K | Y | L | D | A | Lys(C14) | A | A | R | E | F | I | A | W | L | L | N | T | # |
| EU-A852 | 460 | H | G | Q | G | T | F | T | S | D | Y | S | K | Y | L | D | A | Lys(C16) | A | A | R | E | F | I | A | W | L | L | N | T | # |
| EU-A853 | 461 | H | G | Q | G | T | F | T | S | D | Y | S | K | Y | L | D | A | Lys(C18) | A | A | R | E | F | I | A | W | L | L | N | T | # |
| EU-A854 | 462 | H | G | Q | G | T | F | T | S | D | Y | S | K | Y | L | D | A | Lys(C20) | A | A | R | E | F | I | A | W | L | L | N | T | # |
| EU-A855 | 463 | H | G | Q | G | T | F | T | S | D | Y | S | K | Y | L | D | A | Lys(C8) | A | A | K | E | F | I | A | W | L | L | N | T | # |
| EU-A856 | 464 | H | G | Q | G | T | F | T | S | D | Y | S | K | Y | L | D | A | Lys(C12) | A | A | K | E | F | I | A | W | L | L | N | T | # |
| EU-A857 | 465 | H | G | Q | G | T | F | T | S | D | Y | S | K | Y | L | D | A | Lys(C14) | A | A | K | E | F | I | A | W | L | L | N | T | # |
| EU-A858 | 466 | H | G | Q | G | T | F | T | S | D | Y | S | K | Y | L | D | A | Lys(C16) | A | A | K | E | F | I | A | W | L | L | N | T | # |
| EU-A859 | 467 | H | G | Q | G | T | F | T | S | D | Y | S | K | Y | L | D | A | Lys(C18) | A | A | K | E | F | I | A | W | L | L | N | T | # |
| EU-A860 | 468 | H | G | Q | G | T | F | T | S | D | Y | S | K | Y | L | D | A | Lys(C20) | A | A | K | E | F | I | A | W | L | L | N | T | # |
| EU-A861 | 469 | H | G | Q | G | T | F | T | S | D | Y | S | K | Y | L | D | Aib | Lys(C8) | A | A | K | E | F | I | A | W | L | L | N | T | # |
| EU-A862 | 470 | H | G | Q | G | T | F | T | S | D | Y | S | K | Y | L | D | Aib | Lys(C12) | A | A | K | E | F | I | A | W | L | L | N | T | # |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A863 | 471 | H | G | Q | G | T | F | T | S | D | Y | S | K | Y | L | D | Aib | Lys(C14) | A | A | K | E | F | I | A | W | L | L | N | T | # |
| EU-A864 | 472 | H | G | Q | G | T | F | T | S | D | Y | S | K | Y | L | D | Aib | Lys(C16) | A | A | K | E | F | I | A | W | L | L | N | T | # |
| EU-A865 | 473 | H | G | Q | G | T | F | T | S | D | Y | S | K | Y | L | D | Aib | Lys(C18) | A | A | K | E | F | I | A | W | L | L | N | T | # |
| EU-A866 | 474 | H | G | Q | G | T | F | T | S | D | Y | S | K | Y | L | D | Aib | Lys(C20) | A | A | K | E | F | I | A | W | L | L | N | T | # |
| EU-A867 | 475 | H | G | Q | G | T | F | T | S | D | Y | S | K | Y | L | D | Aib | Lys(C8) | A | A | R | E | F | I | A | W | L | L | N | T | # |
| EU-A868 | 476 | H | G | Q | G | T | F | T | S | D | Y | S | K | Y | L | D | Aib | Lys(C12) | A | A | R | E | F | I | A | W | L | L | N | T | # |
| EU-A869 | 477 | H | G | Q | G | T | F | T | S | D | Y | S | K | Y | L | D | Aib | Lys(C14) | A | A | R | E | F | I | A | W | L | L | N | T | # |
| EU-A870 | 478 | H | G | Q | G | T | F | T | S | D | Y | S | K | Y | L | D | Aib | Lys(C16) | A | A | R | E | F | I | A | W | L | L | N | T | # |
| EU-A871 | 479 | H | G | Q | G | T | F | T | S | D | Y | S | K | Y | L | D | Aib | Lys(C18) | A | A | R | E | F | I | A | W | L | L | N | T | # |
| EU-A872 | 480 | H | G | Q | G | T | F | T | S | D | Y | S | K | Y | L | D | Aib | Lys(C20) | A | A | R | E | F | I | A | W | L | L | N | T | # |
| EU-A873 | 481 | H | Aib | Q | G | T | F | T | S | D | Y | S | K | Y | L | D | A | Lys(C8) | A | A | K | E | F | I | A | W | L | L | N | T | # |
| EU-A874 | 482 | H | Aib | Q | G | T | F | T | S | D | Y | S | K | Y | L | D | A | Lys(C12) | A | A | K | E | F | I | A | W | L | L | N | T | # |
| EU-A875 | 483 | H | Aib | Q | G | T | F | T | S | D | Y | S | K | Y | L | D | A | Lys(C14) | A | A | K | E | F | I | A | W | L | L | N | T | # |
| EU-A876 | 484 | H | Aib | Q | G | T | F | T | S | D | Y | S | K | Y | L | D | A | Lys(C16) | A | A | K | E | F | I | A | W | L | L | N | T | # |
| EU-A877 | 485 | H | Aib | Q | G | T | F | T | S | D | Y | S | K | Y | L | D | A | Lys(C18) | A | A | K | E | F | I | A | W | L | L | N | T | # |
| EU-A878 | 486 | H | Aib | Q | G | T | F | T | S | D | Y | S | K | Y | L | D | A | Lys(C20) | A | A | K | E | F | I | A | W | L | L | N | T | # |
| EU-A879 | 487 | H | Aib | Q | G | T | F | T | S | D | Y | S | K | Y | L | D | A | Lys(C8) | A | A | R | E | F | I | A | W | L | L | N | T | # |
| EU-A880 | 488 | H | Aib | Q | G | T | F | T | S | D | Y | S | K | Y | L | D | A | Lys(C12) | A | A | R | E | F | I | A | W | L | L | N | T | # |
| EU-A881 | 489 | H | Aib | Q | G | T | F | T | S | D | Y | S | K | Y | L | D | A | Lys(C14) | A | A | R | E | F | I | A | W | L | L | N | T | # |
| EU-A882 | 490 | H | Aib | Q | G | T | F | T | S | D | Y | S | K | Y | L | D | A | Lys(C16) | A | A | R | E | F | I | A | W | L | L | N | T | # |
| EU-A883 | 491 | H | Aib | Q | G | T | F | T | S | D | Y | S | K | Y | L | D | A | Lys(C18) | A | A | R | E | F | I | A | W | L | L | N | T | # |
| EU-A884 | 492 | H | Aib | Q | G | T | F | T | S | D | Y | S | K | Y | L | D | A | Lys(C20) | A | A | R | E | F | I | A | W | L | L | N | T | # |
| EU-A885 | 493 | H | G | Q | G | T | F | T | S | D | Y | S | K | Y | L | D | A | Q | A | A | R | E | F | I | Lys(C8) | W | L | L | N | T | # |
| EU-A886 | 494 | H | G | Q | G | T | F | T | S | D | Y | S | K | Y | L | D | A | Q | A | A | R | E | F | I | Lys(C12) | W | L | L | N | T | # |
| EU-A887 | 495 | H | G | Q | G | T | F | T | S | D | Y | S | K | Y | L | D | A | Q | A | A | R | E | F | I | Lys(C14) | W | L | L | N | T | # |
| EU-A888 | 496 | H | G | Q | G | T | F | T | S | D | Y | S | K | Y | L | D | A | Q | A | A | R | E | F | I | Lys(C16) | W | L | L | N | T | # |
| EU-A889 | 497 | H | G | Q | G | T | F | T | S | D | Y | S | K | Y | L | D | A | Q | A | A | R | E | F | I | Lys(C18) | W | L | L | N | T | # |
| EU-A890 | 498 | H | G | Q | G | T | F | T | S | D | Y | S | K | Y | L | D | A | Q | A | A | R | E | F | I | Lys(C20) | W | L | L | N | T | # |
| EU-A891 | 499 | H | G | Q | G | T | F | T | S | D | Y | S | K | Y | L | D | A | R | R | A | Lys(C8) | D | F | V | Q | W | L | L | N | T | # |
| EU-A892 | 500 | H | G | Q | G | T | F | T | S | D | Y | S | K | Y | L | D | A | R | R | A | Lys(12) | D | F | V | Q | W | L | L | N | T | # |
| EU-A893 | 501 | H | G | Q | G | T | F | T | S | D | Y | S | K | Y | L | D | A | R | R | A | Lys(C14) | D | F | V | Q | W | L | L | N | T | # |
| EU-A894 | 502 | H | G | Q | G | T | F | T | S | D | Y | S | K | Y | L | D | A | R | R | A | Lys(C16) | D | F | V | Q | W | L | L | N | T | # |
| EU-A895 | 503 | H | G | Q | G | T | F | T | S | D | Y | S | K | Y | L | D | A | R | R | A | Lys(C18) | D | F | V | Q | W | L | L | N | T | # |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A896 | 504 | H | G | Q | G | T | F | T | S | D | Y | S | K | Y | L | D | A | R | R | A | Lys(C20) | D | F | V | Q | W | L | L | N | T | # |
| EU-A897 | 505 | H | Aib | Q | G | T | F | T | S | D | Y | S | K | Y | L | D | A | R | R | A | Lys(C18) | D | F | V | Q | W | L | L | N | T | # |
| EU-A898 | 506 | H | Aib | Q | G | T | F | T | S | D | Y | S | K | Y | L | D | A | R | R | A | Lys(C8) | D | F | V | Q | W | L | L | N | T | # |
| EU-A899 | 507 | H | Aib | Q | G | T | F | T | S | D | Y | S | K | Y | L | D | A | R | R | A | Lys(C14) | D | F | V | Q | W | L | L | N | T | # |
| EU-A900 | 508 | H | Aib | Q | G | T | F | T | S | D | Y | S | K | Y | L | D | A | R | R | A | Lys(C16) | D | F | V | Q | W | L | L | N | T | # |
| EU-A901 | 509 | H | Aib | Q | G | T | F | T | S | D | Y | S | K | Y | L | D | A | R | R | A | Lys(C20) | D | F | V | Q | W | L | L | N | T | # |
| EU-A902 | 510 | H | G | Q | G | T | F | T | S | D | Y | S | K | Y | L | D | A | R | R | A | Q | D | F | V | Lys(C8) | W | L | L | N | T | # |
| EU-A903 | 511 | H | G | Q | G | T | F | T | S | D | Y | S | K | Y | L | D | A | R | R | A | Q | D | F | V | Lys(C12) | W | L | L | N | T | # |
| EU-A904 | 512 | H | G | Q | G | T | F | T | S | D | Y | S | K | Y | L | D | A | R | R | A | Q | D | F | V | Lys(C14) | W | L | L | N | T | # |
| EU-A905 | 513 | H | G | Q | G | T | F | T | S | D | Y | S | K | Y | L | D | A | R | R | A | Q | D | F | V | Lys(C16) | W | L | L | N | T | # |
| EU-A906 | 514 | H | G | Q | G | T | F | T | S | D | Y | S | K | Y | L | D | A | R | R | A | Q | D | F | V | Lys(C18) | W | L | L | N | T | # |
| EU-A907 | 515 | H | G | Q | G | T | F | T | S | D | Y | S | K | Y | L | D | A | R | R | A | Q | D | F | V | Lys(C20) | W | L | L | N | T | # |
| EU-A908 | 516 | H | Aib | Q | G | T | F | T | S | D | Y | S | K | Y | L | D | Aib | Lys(C18) | A | A | K | E | F | I | A | W | L | L | N | T | # |
| EU-A909 | 517 | H | Aib | Q | G | T | F | T | S | D | Y | S | K | Y | L | D | Aib | Lys(C8) | A | A | K | E | F | I | A | W | L | L | N | T | # |
| EU-A910 | 518 | H | Aib | Q | G | T | F | T | S | D | Y | S | K | Y | L | D | Aib | Lys(C12) | A | A | K | E | F | I | A | W | L | L | N | T | # |
| EU-A911 | 519 | H | Aib | Q | G | T | F | T | S | D | Y | S | K | Y | L | D | Aib | Lys(C14) | A | A | K | E | F | I | A | W | L | L | N | T | # |
| EU-A912 | 520 | H | Aib | Q | G | T | F | T | S | D | Y | S | K | Y | L | D | Aib | Lys(C16) | A | A | K | E | F | I | A | W | L | L | N | T | # |
| EU-A913 | 521 | H | Aib | Q | G | T | F | T | S | D | Y | S | K | Y | L | D | Aib | Lys(C18) | A | A | K | E | F | I | A | W | L | L | N | T | # |
| EU-A914 | 522 | H | Aib | Q | G | T | F | T | S | D | Y | S | K | Y | L | D | Aib | Lys(C20) | A | A | K | E | F | I | A | W | L | L | N | T | # |
| EU-A915 | 523 | H | Aib | Q | G | T | F | T | S | D | Y | S | K | Y | L | D | Aib | Lys(C8) | A | A | R | E | F | I | A | W | L | L | N | T | # |
| EU-A916 | 524 | H | Aib | Q | G | T | F | T | S | D | Y | S | K | Y | L | D | Aib | Lys(C12) | A | A | R | E | F | I | A | W | L | L | N | T | # |
| EU-A917 | 525 | H | Aib | Q | G | T | F | T | S | D | Y | S | K | Y | L | D | Aib | Lys(C14) | A | A | R | E | F | I | A | W | L | L | N | T | # |
| EU-A918 | 526 | H | Aib | Q | G | T | F | T | S | D | Y | S | K | Y | L | D | Aib | Lys(C16) | A | A | R | E | F | I | A | W | L | L | N | T | # |
| EU-A919 | 527 | H | Aib | Q | G | T | F | T | S | D | Y | S | K | Y | L | D | Aib | Lys(C18) | A | A | R | E | F | I | A | W | L | L | N | T | # |
| EU-A920 | 528 | H | Aib | Q | G | T | F | T | S | D | Y | S | K | Y | L | D | Aib | Lys(C20) | A | A | R | E | F | I | A | W | L | L | N | T | # |
| EU-A921 | 529 | H | Aib | Q | G | T | F | T | S | D | Y | S | K | Y | L | D | Aib | R | R | A | Lys(C18) | D | F | V | Q | W | L | L | N | T | # |
| EU-A922 | 530 | H | Aib | Q | G | T | F | T | S | D | Y | S | K | Y | L | D | Aib | R | R | A | Lys(C8) | D | F | V | Q | W | L | L | N | T | # |
| EU-A923 | 531 | H | Aib | Q | G | T | F | T | S | D | Y | S | K | Y | L | D | Aib | R | R | A | Lys(C14) | D | F | V | Q | W | L | L | N | T | # |
| EU-A924 | 532 | H | Aib | Q | G | T | F | T | S | D | Y | S | K | Y | L | D | Aib | R | R | A | Lys(C16) | D | F | V | Q | W | L | L | N | T | # |
| EU-A925 | 533 | H | Aib | Q | G | T | F | T | S | D | Y | S | K | Y | L | D | Aib | R | R | A | Lys(C20) | D | F | V | Q | W | L | L | N | T | # |
| EU-A926 | 534 | H | G | Q | G | T | F | T | S | D | Y | S | K | Y | L | D | Aib | R | R | A | Lys(C8) | D | F | V | Q | W | L | L | N | T | # |
| EU-A927 | 535 | H | G | Q | G | T | F | T | S | D | Y | S | K | Y | L | D | Aib | R | R | A | Lys(C12) | D | F | V | Q | W | L | L | N | T | # |
| EU-A928 | 536 | H | G | Q | G | T | F | T | S | D | Y | S | K | Y | L | D | Aib | R | R | A | Lys(C14) | D | F | V | Q | W | L | L | N | T | # |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A929 | 537 | H | G | Q | G | T | F | T | S | D | Y | S | K | Y | L | D | Aib | R | R | A | Lys(C16) | D | F | V | Q | W | L | L | N | T | # |
| EU-A930 | 538 | H | G | Q | G | T | F | T | S | D | Y | S | K | Y | L | D | Aib | R | R | A | Lys(C18) | D | F | V | Q | W | L | L | N | T | # |
| EU-A931 | 539 | H | G | Q | G | T | F | T | S | D | Y | S | K | Y | L | D | Aib | R | R | A | Lys(C20) | D | F | V | Q | W | L | L | N | T | # |
| EU-A932 | 540 | H | G | Q | G | T | F | T | S | D | Y | S | K | Y | L | D | Aib | Q | A | A | R | E | F | I | Lys(C8) | W | L | L | N | T | # |
| EU-A933 | 541 | H | G | Q | G | T | F | T | S | D | Y | S | K | Y | L | D | Aib | Q | A | A | R | E | F | I | Lys(C12) | W | L | L | N | T | # |
| EU-A934 | 542 | H | G | Q | G | T | F | T | S | D | Y | S | K | Y | L | D | Aib | Q | A | A | R | E | F | I | Lys(C14) | W | L | L | N | T | # |
| EU-A935 | 543 | H | G | Q | G | T | F | T | S | D | Y | S | K | Y | L | D | Aib | Q | A | A | R | E | F | I | Lys(C16) | W | L | L | N | T | # |
| EU-A936 | 544 | H | G | Q | G | T | F | T | S | D | Y | S | K | Y | L | D | Aib | Q | A | A | R | E | F | I | Lys(C18) | W | L | L | N | T | # |
| EU-A937 | 545 | H | G | Q | G | T | F | T | S | D | Y | S | K | Y | L | D | Aib | Q | A | A | R | E | F | I | Lys(C20) | W | L | L | N | T | # |
| EU-A938 | 546 | H | G | Q | G | T | F | T | S | D | Y | S | K | Y | L | D | Aib | R | R | A | Q | D | F | V | Lys(C8) | W | L | L | N | T | # |
| EU-A939 | 547 | H | G | Q | G | T | F | T | S | D | Y | S | K | Y | L | D | Aib | R | R | A | Q | D | F | V | Lys(C12) | W | L | L | N | T | # |
| EU-A940 | 548 | H | G | Q | G | T | F | T | S | D | Y | S | K | Y | L | D | Aib | R | R | A | Q | D | F | V | Lys(C14) | W | L | L | N | T | # |
| EU-A941 | 549 | H | G | Q | G | T | F | T | S | D | Y | S | K | Y | L | D | Aib | R | R | A | Q | D | F | V | Lys(C16) | W | L | L | N | T | # |
| EU-A942 | 550 | H | G | Q | G | T | F | T | S | D | Y | S | K | Y | L | D | Aib | R | R | A | Q | D | F | V | Lys(C18) | W | L | L | N | T | # |
| EU-A943 | 551 | H | G | Q | G | T | F | T | S | D | Y | S | K | Y | L | D | Aib | R | R | A | Q | D | F | V | Lys(C20) | W | L | L | N | T | # |
| EU-A944 | 552 | H | G | Q | G | T | F | T | S | D | Y | S | K | Y | L | D | E | Q | A | A | R | E | F | I | Lys(C8) | W | L | L | Q | T | # |
| EU-A945 | 553 | H | G | Q | G | T | F | T | S | D | Y | S | K | Y | L | D | E | Q | A | A | R | E | F | I | Lys(C12) | W | L | L | Q | T | # |
| EU-A946 | 554 | H | G | Q | G | T | F | T | S | D | Y | S | K | Y | L | D | E | Q | A | A | R | E | F | I | Lys(C14) | W | L | L | Q | T | # |
| EU-A947 | 555 | H | G | Q | G | T | F | T | S | D | Y | S | K | Y | L | D | E | Q | A | A | R | E | F | I | Lys(C16) | W | L | L | Q | T | # |
| EU-A948 | 556 | H | G | Q | G | T | F | T | S | D | Y | S | K | Y | L | D | E | Q | A | A | R | E | F | I | Lys(C18) | W | L | L | Q | T | # |
| EU-A949 | 557 | H | G | Q | G | T | F | T | S | D | Y | S | K | Y | L | D | E | Q | A | A | R | E | F | I | Lys(C20) | W | L | L | Q | T | # |
| EU-A950 | 558 | H | G | Q | G | T | F | T | S | D | Y | S | K | Y | L | D | E | Lys(C8) | A | A | R | E | F | I | A | W | L | L | Q | T | # |
| EU-A951 | 559 | H | G | Q | G | T | F | T | S | D | Y | S | K | Y | L | D | E | Lys(C12) | A | A | R | E | F | I | A | W | L | L | Q | T | # |
| EU-A952 | 560 | H | G | Q | G | T | F | T | S | D | Y | S | K | Y | L | D | E | Lys(C14) | A | A | R | E | F | I | A | W | L | L | Q | T | # |
| EU-A953 | 561 | H | G | Q | G | T | F | T | S | D | Y | S | K | Y | L | D | E | Lys(C16) | A | A | R | E | F | I | A | W | L | L | Q | T | # |
| EU-A954 | 562 | H | G | Q | G | T | F | T | S | D | Y | S | K | Y | L | D | E | Lys(C18) | A | A | R | E | F | I | A | W | L | L | Q | T | # |
| EU-A955 | 563 | H | G | Q | G | T | F | T | S | D | Y | S | K | Y | L | D | E | Lys(C20) | A | A | R | E | F | I | A | W | L | L | Q | T | # |
| EU-A956 | 564 | H | G | Q | G | T | F | T | S | D | Y | S | K | Y | L | D | E | Lys(C8) | A | A | K | E | F | I | A | W | L | L | Q | T | # |
| EU-A957 | 565 | H | G | Q | G | T | F | T | S | D | Y | S | K | Y | L | D | E | Lys(C12) | A | A | K | E | F | I | A | W | L | L | Q | T | # |
| EU-A958 | 566 | H | G | Q | G | T | F | T | S | D | Y | S | K | Y | L | D | E | Lys(C14) | A | A | K | E | F | I | A | W | L | L | Q | T | # |
| EU-A959 | 567 | H | G | Q | G | T | F | T | S | D | Y | S | K | Y | L | D | E | Lys(C16) | A | A | K | E | F | I | A | W | L | L | Q | T | # |
| EU-A960 | 568 | H | G | Q | G | T | F | T | S | D | Y | S | K | Y | L | D | E | Lys(C18) | A | A | K | E | F | I | A | W | L | L | Q | T | # |
| EU-A961 | 569 | H | G | Q | G | T | F | T | S | D | Y | S | K | Y | L | D | E | Lys(C20) | A | A | K | E | F | I | A | W | L | L | Q | T | # |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A962 | 570 | H | Aib | Q | G | T | F | T | S | D | Y | S | K | Y | L | D | E | Lys(C8) | A | A | K | E | F | I | A | W | L | L | Q | T | # |
| EU-A963 | 571 | H | Aib | Q | G | T | F | T | S | D | Y | S | K | Y | L | D | E | Lys(C12) | A | A | K | E | F | I | A | W | L | L | Q | T | # |
| EU-A964 | 572 | H | Aib | Q | G | T | F | T | S | D | Y | S | K | Y | L | D | E | Lys(C14) | A | A | K | E | F | I | A | W | L | L | Q | T | # |
| EU-A965 | 573 | H | Aib | Q | G | T | F | T | S | D | Y | S | K | Y | L | D | E | Lys(C16) | A | A | K | E | F | I | A | W | L | L | Q | T | # |
| EU-A966 | 574 | H | Aib | Q | G | T | F | T | S | D | Y | S | K | Y | L | D | E | Lys(C18) | A | A | K | E | F | I | A | W | L | L | Q | T | # |
| EU-A967 | 575 | H | Aib | Q | G | T | F | T | S | D | Y | S | K | Y | L | D | E | Lys(C20) | A | A | K | E | F | I | A | W | L | L | Q | T | # |
| EU-A968 | 576 | H | Aib | Q | G | T | F | T | S | D | Y | S | K | Y | L | D | Aib | Lys(C8) | A | A | R | E | F | I | A | W | L | L | Q | T | # |
| EU-A969 | 577 | H | Aib | Q | G | T | F | T | S | D | Y | S | K | Y | L | D | Aib | Lys(C12) | A | A | R | E | F | I | A | W | L | L | Q | T | # |
| EU-A970 | 578 | H | Aib | Q | G | T | F | T | S | D | Y | S | K | Y | L | D | Aib | Lys(C14) | A | A | R | E | F | I | A | W | L | L | Q | T | # |
| EU-A971 | 579 | H | Aib | Q | G | T | F | T | S | D | Y | S | K | Y | L | D | Aib | Lys(C16) | A | A | R | E | F | I | A | W | L | L | Q | T | # |
| EU-A972 | 580 | H | Aib | Q | G | T | F | T | S | D | Y | S | K | Y | L | D | Aib | Lys(C18) | A | A | R | E | F | I | A | W | L | L | Q | T | # |
| EU-A973 | 581 | H | Aib | Q | G | T | F | T | S | D | Y | S | K | Y | L | D | Aib | Lys(C20) | A | A | R | E | F | I | A | W | L | L | Q | T | # |
| EU-A974 | 582 | H | G | Q | G | T | F | T | S | D | Y | S | K | Y | L | D | E | R | R | A | Lys(C8) | D | F | V | Q | W | L | L | Q | T | # |
| EU-A975 | 583 | H | G | Q | G | T | F | T | S | D | Y | S | K | Y | L | D | E | R | R | A | Lys(C12) | D | F | V | Q | W | L | L | Q | T | # |
| EU-A976 | 584 | H | G | Q | G | T | F | T | S | D | Y | S | K | Y | L | D | E | R | R | A | Lys(C14) | D | F | V | Q | W | L | L | Q | T | # |
| EU-A977 | 585 | H | G | Q | G | T | F | T | S | D | Y | S | K | Y | L | D | E | R | R | A | Lys(C16) | D | F | V | Q | W | L | L | Q | T | # |
| EU-A978 | 586 | H | G | Q | G | T | F | T | S | D | Y | S | K | Y | L | D | E | R | R | A | Lys(C18) | D | F | V | Q | W | L | L | Q | T | # |
| EU-A979 | 587 | H | G | Q | G | T | F | T | S | D | Y | S | K | Y | L | D | E | R | R | A | Lys(C20) | D | F | V | Q | W | L | L | Q | T | # |
| EU-A980 | 588 | H | Aib | Q | G | T | F | T | S | D | Y | S | K | Y | L | D | E | R | R | A | Lys(C8) | D | F | V | Q | W | L | L | Q | T | # |
| EU-A981 | 589 | H | Aib | Q | G | T | F | T | S | D | Y | S | K | Y | L | D | E | R | R | A | Lys(C12) | D | F | V | Q | W | L | L | Q | T | # |
| EU-A982 | 590 | H | Aib | Q | G | T | F | T | S | D | Y | S | K | Y | L | D | E | R | R | A | Lys(C14) | D | F | V | Q | W | L | L | Q | T | # |
| EU-A983 | 591 | H | Aib | Q | G | T | F | T | S | D | Y | S | K | Y | L | D | E | R | R | A | Lys(C16) | D | F | V | Q | W | L | L | Q | T | # |
| EU-A984 | 592 | H | Aib | Q | G | T | F | T | S | D | Y | S | K | Y | L | D | E | R | R | A | Lys(C18) | D | F | V | Q | W | L | L | Q | T | # |
| EU-A985 | 593 | H | Aib | Q | G | T | F | T | S | D | Y | S | K | Y | L | D | E | R | R | A | Lys(C20) | D | F | V | Q | W | L | L | Q | T | # |
| EU-A986 | 594 | H | Aib | Q | G | T | F | T | S | D | Y | S | K | Y | L | D | E* | Q | A | A | K* | E | F | I | Lys(C8) | W | L | M | Q | T | # |
| EU-A987 | 595 | H | Aib | Q | G | T | F | T | S | D | Y | S | K | Y | L | D | E* | Q | A | A | K* | E | F | I | Lys(C12) | W | L | M | Q | T | # |
| EU-A988 | 596 | H | Aib | Q | G | T | F | T | S | D | Y | S | K | Y | L | D | E* | Q | A | A | K* | E | F | I | Lys(C14) | W | L | M | Q | T | # |
| EU-A989 | 597 | H | Aib | Q | G | T | F | T | S | D | Y | S | K | Y | L | D | E* | Q | A | A | K* | E | F | I | Lys(C16) | W | L | M | Q | T | # |
| EU-A990 | 598 | H | Aib | Q | G | T | F | T | S | D | Y | S | K | Y | L | D | E* | Q | A | A | K* | E | F | I | Lys(C18) | W | L | M | Q | T | # |
| EU-A991 | 599 | H | Aib | Q | G | T | F | T | S | D | Y | S | K | Y | L | D | E* | Q | A | A | K* | E | F | I | Lys(C20) | W | L | M | Q | T | # |
| EU-A992 | 600 | H | Aib | Q | G | T | F | T | S | D | Y | S | K | Y | L | D | E* | Q | A | A | K* | E | F | I | Lys(C8) | W | L | L | Q | T | # |
| EU-A993 | 601 | H | Aib | Q | G | T | F | T | S | D | Y | S | K | Y | L | D | E* | Q | A | A | K* | E | F | I | Lys(C12) | W | L | L | Q | T | # |
| EU-A994 | 602 | H | Aib | Q | G | T | F | T | S | D | Y | S | K | Y | L | D | E* | Q | A | A | K* | E | F | I | Lys(C14) | W | L | L | Q | T | # |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A995 | 603 | H | Aib | Q | G | T | F | T | S | D | Y | S | K | Y | L | D | E* | Q | A | A | K* | E | F | I | Lys(C16) | W | L | L | Q | T | # |
| EU-A996 | 604 | H | Aib | Q | G | T | F | T | S | D | Y | S | K | Y | L | D | E* | Q | A | A | K* | E | F | I | Lys(C18) | W | L | L | Q | T | # |
| EU-A997 | 605 | H | Aib | Q | G | T | F | T | S | D | Y | S | K | Y | L | D | E* | Q | A | A | K* | E | F | I | Lys(C20) | W | L | L | Q | T | # |
| EU-A998 | 606 | H | Aib | Q | G | T | F | T | S | D | Y | S | K | Y | L | D | E* | Q | A | A | K* | E | F | I | Lys(M8) | W | L | L | Q | T | # |
| EU-A999 | 607 | H | Aib | Q | G | T | F | T | S | D | Y | S | K | Y | L | D | E* | Q | A | A | K* | E | F | I | Lys(M12) | W | L | L | Q | T | # |
| EU-A1000 | 608 | H | Aib | Q | G | T | F | T | S | D | Y | S | K | Y | L | D | E* | Q | A | A | K* | E | F | I | Lys(M14) | W | L | L | Q | T | # |
| EU-A1001 | 609 | H | Aib | Q | G | T | F | T | S | D | Y | S | K | Y | L | D | E* | Q | A | A | K* | E | F | I | Lys(M16) | W | L | L | Q | T | # |
| EU-A1002 | 610 | H | Aib | Q | G | T | F | T | S | D | Y | S | K | Y | L | D | E* | Q | A | A | K* | E | F | I | Lys(M18) | W | L | L | Q | T | # |
| EU-A1003 | 611 | H | Aib | Q | G | T | F | T | S | D | Y | S | K | Y | L | D | E* | Q | A | A | K* | E | F | I | Lys(M20) | W | L | L | Q | T | # |
| EU-A1004 | 612 | H | G | Q | G | T | F | T | S | D | Y | S | K | Y | L | D | E | Q | A | A | R | E | F | I | Lys(M8) | W | L | L | Q | T | # |
| EU-A1005 | 613 | H | G | Q | G | T | F | T | S | D | Y | S | K | Y | L | D | E | Q | A | A | R | E | F | I | Lys(M12) | W | L | L | Q | T | # |
| EU-A1006 | 614 | H | G | Q | G | T | F | T | S | D | Y | S | K | Y | L | D | E | Q | A | A | R | E | F | I | Lys(M14) | W | L | L | Q | T | # |
| EU-A1007 | 615 | H | G | Q | G | T | F | T | S | D | Y | S | K | Y | L | D | E | Q | A | A | R | E | F | I | Lys(M16) | W | L | L | Q | T | # |
| EU-A1008 | 616 | H | G | Q | G | T | F | T | S | D | Y | S | K | Y | L | D | E | Q | A | A | R | E | F | I | Lys(M18) | W | L | L | Q | T | # |
| EU-A1009 | 617 | H | G | Q | G | T | F | T | S | D | Y | S | K | Y | L | D | E | Q | A | A | R | E | F | I | Lys(M20) | W | L | L | Q | T | # |
| EU-A1010 | 618 | H | G | Q | G | T | F | T | S | D | Y | S | K | Y | L | D | E | Lys(M8) | A | A | K | E | F | I | A | W | L | L | N | T | # |
| EU-A1011 | 619 | H | G | Q | G | T | F | T | S | D | Y | S | K | Y | L | D | E | Lys(M12) | A | A | K | E | F | I | A | W | L | L | N | T | # |
| EU-A1012 | 620 | H | G | Q | G | T | F | T | S | D | Y | S | K | Y | L | D | E | Lys(M14) | A | A | K | E | F | I | A | W | L | L | N | T | # |
| EU-A1013 | 621 | H | G | Q | G | T | F | T | S | D | Y | S | K | Y | L | D | E | Lys(M16) | A | A | K | E | F | I | A | W | L | L | N | T | # |
| EU-A1014 | 622 | H | G | Q | G | T | F | T | S | D | Y | S | K | Y | L | D | E | Lys(M18) | A | A | K | E | F | I | A | W | L | L | N | T | # |
| EU-A1015 | 623 | H | G | Q | G | T | F | T | S | D | Y | S | K | Y | L | D | E | Lys(M20) | A | A | K | E | F | I | A | W | L | L | N | T | # |
| EU-A1016 | 624 | H | G | Q | G | T | F | T | S | D | Y | S | K | Y | L | D | E | Lys(M8) | A | A | R | E | F | I | A | W | L | L | Q | T | # |
| EU-A1017 | 625 | H | G | Q | G | T | F | T | S | D | Y | S | K | Y | L | D | E | Lys(M12) | A | A | R | E | F | I | A | W | L | L | Q | T | # |
| EU-A1018 | 626 | H | G | Q | G | T | F | T | S | D | Y | S | K | Y | L | D | E | Lys(M14) | A | A | R | E | F | I | A | W | L | L | Q | T | # |
| EU-A1019 | 627 | H | G | Q | G | T | F | T | S | D | Y | S | K | Y | L | D | E | Lys(M16) | A | A | R | E | F | I | A | W | L | L | Q | T | # |
| EU-A1020 | 628 | H | G | Q | G | T | F | T | S | D | Y | S | K | Y | L | D | E | Lys(M18) | A | A | R | E | F | I | A | W | L | L | Q | T | # |
| EU-A1021 | 629 | H | G | Q | G | T | F | T | S | D | Y | S | K | Y | L | D | E | Lys(M20) | A | A | R | E | F | I | A | W | L | L | Q | T | # |
| EU-A1022 | 630 | H | Aib | Q | G | T | F | T | S | D | Y | S | K | Y | L | D | E* | Q | A | A | K* | E | F | I | Lys(Me8) | W | L | L | Q | T | # |
| EU-A1023 | 631 | H | Aib | Q | G | T | F | T | S | D | Y | S | K | Y | L | D | E* | Q | A | A | K* | E | F | I | Lys(Me12) | W | L | L | Q | T | # |
| EU-A1024 | 632 | H | Aib | Q | G | T | F | T | S | D | Y | S | K | Y | L | D | E* | Q | A | A | K* | E | F | I | Lys(Me14) | W | L | L | Q | T | # |
| EU-A1025 | 633 | H | Aib | Q | G | T | F | T | S | D | Y | S | K | Y | L | D | E* | Q | A | A | K* | E | F | I | Lys(Me16) | W | L | L | Q | T | # |
| EU-A1026 | 634 | H | Aib | Q | G | T | F | T | S | D | Y | S | K | Y | L | D | E* | Q | A | A | K* | E | F | I | Lys(Me18) | W | L | L | Q | T | # |
| EU-A1027 | 635 | H | Aib | Q | G | T | F | T | S | D | Y | S | K | Y | L | D | E* | Q | A | A | K* | E | F | I | Lys(Me20) | W | L | L | Q | T | # |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A1028 | 636 | H | G | Q | G | T | F | T | S | D | Y | S | K | Y | L | D | E | Q | A | A | R | E | F | I | Lys(Me8) | W | L | L | Q | T | # |
| EU-A1029 | 637 | H | G | Q | G | T | F | T | S | D | Y | S | K | Y | L | D | E | Q | A | A | R | E | F | I | Lys(Me12) | W | L | L | Q | T | # |
| EU-A1030 | 638 | H | G | Q | G | T | F | T | S | D | Y | S | K | Y | L | D | E | Q | A | A | R | E | F | I | Lys(Me14) | W | L | L | Q | T | # |
| EU-A1031 | 639 | H | G | Q | G | T | F | T | S | D | Y | S | K | Y | L | D | E | Q | A | A | R | E | F | I | Lys(Me16) | W | L | L | Q | T | # |
| EU-A1032 | 640 | H | G | Q | G | T | F | T | S | D | Y | S | K | Y | L | D | E | Q | A | A | R | E | F | I | Lys(Me18) | W | L | L | Q | T | # |
| EU-A1033 | 641 | H | G | Q | G | T | F | T | S | D | Y | S | K | Y | L | D | E | Q | A | A | R | E | F | I | Lys(Me20) | W | L | L | Q | T | # |
| EU-A1034 | 642 | H | G | Q | G | T | F | T | S | D | Y | S | K | Y | L | D | E | Lys(Me8) | A | A | K | E | F | I | A | W | L | L | N | T | # |
| EU-A1035 | 643 | H | G | Q | G | T | F | T | S | D | Y | S | K | Y | L | D | E | Lys(Me12) | A | A | K | E | F | I | A | W | L | L | N | T | # |
| EU-A1036 | 644 | H | G | Q | G | T | F | T | S | D | Y | S | K | Y | L | D | E | Lys(Me14) | A | A | K | E | F | I | A | W | L | L | N | T | # |
| EU-A1037 | 645 | H | G | Q | G | T | F | T | S | D | Y | S | K | Y | L | D | E | Lys(Me16) | A | A | K | E | F | I | A | W | L | L | N | T | # |
| EU-A1038 | 646 | H | G | Q | G | T | F | T | S | D | Y | S | K | Y | L | D | E | Lys(Me18) | A | A | K | E | F | I | A | W | L | L | N | T | # |
| EU-A1039 | 647 | H | G | Q | G | T | F | T | S | D | Y | S | K | Y | L | D | E | Lys(Me20) | A | A | K | E | F | I | A | W | L | L | N | T | # |
| EU-A1040 | 648 | H | G | Q | G | T | F | T | S | D | Y | S | K | Y | L | D | E | Lys(Me8) | A | A | R | E | F | I | A | W | L | L | Q | T | # |
| EU-A1041 | 649 | H | G | Q | G | T | F | T | S | D | Y | S | K | Y | L | D | E | Lys(Me12) | A | A | R | E | F | I | A | W | L | L | Q | T | # |
| EU-A1042 | 650 | H | G | Q | G | T | F | T | S | D | Y | S | K | Y | L | D | E | Lys(Me14) | A | A | R | E | F | I | A | W | L | L | Q | T | # |
| EU-A1043 | 651 | H | G | Q | G | T | F | T | S | D | Y | S | K | Y | L | D | E | Lys(Me16) | A | A | R | E | F | I | A | W | L | L | Q | T | # |
| EU-A1044 | 652 | H | G | Q | G | T | F | T | S | D | Y | S | K | Y | L | D | E | Lys(Me18) | A | A | R | E | F | I | A | W | L | L | Q | T | # |
| EU-A1045 | 653 | H | G | Q | G | T | F | T | S | D | Y | S | K | Y | L | D | E | Lys(Me20) | A | A | R | E | F | I | A | W | L | L | Q | T | # |
| EU-A1046 | 654 | H | αMePro | Q | G | T | αMeF | T | S | D | EtBip | Lys(C8) | # | | | | | | | | | | | | | | | | | | |
| EU-A1047 | 655 | H | αMePro | Q | G | T | αMeF | T | S | D | EtBip | Lys(C12) | # | | | | | | | | | | | | | | | | | | |
| EU-A1048 | 656 | H | αMePro | Q | G | T | αMeF | T | S | D | EtBip | Lys(C14) | # | | | | | | | | | | | | | | | | | | |
| EU-A1049 | 657 | H | αMePro | Q | G | T | αMeF | T | S | D | EtBip | Lys(C16) | # | | | | | | | | | | | | | | | | | | |
| EU-A1050 | 658 | H | αMePro | Q | G | T | αMeF | T | S | D | EtBip | Lys(C18) | # | | | | | | | | | | | | | | | | | | |
| EU-A1051 | 659 | H | αMePro | Q | G | T | αMeF | T | S | D | EtBip | Lys(C20) | # | | | | | | | | | | | | | | | | | | |
| EU-A1052 | 660 | H | αMePro | Q | G | T | αMeFF | T | S | D | EtBip | Lys(C8) | # | | | | | | | | | | | | | | | | | | |
| EU-A1053 | 661 | H | αMePro | Q | G | T | αMeFF | T | S | D | EtBip | Lys(C12) | # | | | | | | | | | | | | | | | | | | |
| EU-A1054 | 662 | H | αMePro | Q | G | T | αMeFF | T | S | D | EtBip | Lys(C14) | # | | | | | | | | | | | | | | | | | | |
| EU-A1055 | 663 | H | αMePro | Q | G | T | αMeFF | T | S | D | EtBip | Lys(C16) | # | | | | | | | | | | | | | | | | | | |
| EU-A1056 | 664 | H | αMePro | Q | G | T | αMeFF | T | S | D | EtBip | Lys(C18) | # | | | | | | | | | | | | | | | | | | |
| EU-A1057 | 665 | H | αMePro | Q | G | T | αMeFF | T | S | D | EtBip | Lys(C20) | # | | | | | | | | | | | | | | | | | | |
| EU-A1058 | 666 | H | Aib | Q | G | T | αMeF | T | S | D | EtBip | Lys(C8) | # | | | | | | | | | | | | | | | | | | |
| EU-A1059 | 667 | H | Aib | Q | G | T | αMeF | T | S | D | EtBip | Lys(C12) | # | | | | | | | | | | | | | | | | | | |
| EU-A1060 | 668 | H | Aib | Q | G | T | αMeF | T | S | D | EtBip | Lys(C14) | # | | | | | | | | | | | | | | | | | | |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A1061 | 669 | H | Aib | Q | G | T | αMeF | T | S | D | EtBip | Lys(C16) | # | | | | | | | | | | | | | | | | | | |
| EU-A1062 | 670 | H | Aib | Q | G | T | αMeF | T | S | D | EtBip | Lys(C18) | # | | | | | | | | | | | | | | | | | | |
| EU-A1063 | 671 | H | Aib | Q | G | T | αMeF | T | S | D | EtBip | Lys(C20) | # | | | | | | | | | | | | | | | | | | |
| EU-A1064 | 672 | H | Aib | Q | G | T | αMeFF | T | S | D | EtBip | Lys(C8) | # | | | | | | | | | | | | | | | | | | |
| EU-A1065 | 673 | H | Aib | Q | G | T | αMeFF | T | S | D | EtBip | Lys(C12) | # | | | | | | | | | | | | | | | | | | |
| EU-A1066 | 674 | H | Aib | Q | G | T | αMeFF | T | S | D | EtBip | Lys(C14) | # | | | | | | | | | | | | | | | | | | |
| EU-A1067 | 675 | H | Aib | Q | G | T | αMeFF | T | S | D | EtBip | Lys(C16) | # | | | | | | | | | | | | | | | | | | |
| EU-A1068 | 676 | H | Aib | Q | G | T | αMeFF | T | S | D | EtBip | Lys(C18) | # | | | | | | | | | | | | | | | | | | |
| EU-A1069 | 677 | H | Aib | Q | G | T | αMeFF | T | S | D | EtBip | Lys(C20) | # | | | | | | | | | | | | | | | | | | |
| EU-A1070 | 678 | H | αMePro | Q | G | T | αMeF | T | S | D | EtBip | MeLys(C8) | # | | | | | | | | | | | | | | | | | | |
| EU-A1071 | 679 | H | αMePro | Q | G | T | αMeF | T | S | D | EtBip | MeLys(C12) | # | | | | | | | | | | | | | | | | | | |
| EU-A1072 | 680 | H | αMePro | Q | G | T | αMeF | T | S | D | EtBip | MeLys(C14) | # | | | | | | | | | | | | | | | | | | |
| EU-A1073 | 681 | H | αMePro | Q | G | T | αMeF | T | S | D | EtBip | MeLys(C16) | # | | | | | | | | | | | | | | | | | | |
| EU-A1074 | 682 | H | αMePro | Q | G | T | αMeF | T | S | D | EtBip | MeLys(C18) | # | | | | | | | | | | | | | | | | | | |
| EU-A1075 | 683 | H | αMePro | Q | G | T | αMeF | T | S | D | EtBip | MeLys(C20) | # | | | | | | | | | | | | | | | | | | |
| EU-A1076 | 684 | H | αMePro | Q | G | T | αMeFF | T | S | D | EtBip | MeLys(C8) | # | | | | | | | | | | | | | | | | | | |
| EU-A1077 | 685 | H | αMePro | Q | G | T | αMeFF | T | S | D | EtBip | MeLys(C12) | # | | | | | | | | | | | | | | | | | | |
| EU-A1078 | 686 | H | αMePro | Q | G | T | αMeFF | T | S | D | EtBip | MeLys(C14) | # | | | | | | | | | | | | | | | | | | |
| EU-A1079 | 687 | H | αMePro | Q | G | T | αMeFF | T | S | D | EtBip | MeLys(C16) | # | | | | | | | | | | | | | | | | | | |
| EU-A1080 | 688 | H | αMePro | Q | G | T | αMeFF | T | S | D | EtBip | MeLys(C18) | # | | | | | | | | | | | | | | | | | | |
| EU-A1081 | 689 | H | αMePro | Q | G | T | αMeFF | T | S | D | EtBip | MeLys(C20) | # | | | | | | | | | | | | | | | | | | |
| EU-A1082 | 690 | H | Aib | Q | G | T | αMeF | T | S | D | EtBip | MeLys(C8) | # | | | | | | | | | | | | | | | | | | |
| EU-A1083 | 691 | H | Aib | Q | G | T | αMeF | T | S | D | EtBip | MeLys(C12) | # | | | | | | | | | | | | | | | | | | |
| EU-A1084 | 692 | H | Aib | Q | G | T | αMeF | T | S | D | EtBip | MeLys(C14) | # | | | | | | | | | | | | | | | | | | |
| EU-A1085 | 693 | H | Aib | Q | G | T | αMeF | T | S | D | EtBip | MeLys(C16) | # | | | | | | | | | | | | | | | | | | |
| EU-A1086 | 694 | H | Aib | Q | G | T | αMeF | T | S | D | EtBip | MeLys(C18) | # | | | | | | | | | | | | | | | | | | |
| EU-A1087 | 695 | H | Aib | Q | G | T | αMeF | T | S | D | EtBip | MeLys(C20) | # | | | | | | | | | | | | | | | | | | |
| EU-A1088 | 696 | H | Aib | Q | G | T | αMeFF | T | S | D | EtBip | MeLys(C8) | # | | | | | | | | | | | | | | | | | | |
| EU-A1089 | 697 | H | Aib | Q | G | T | αMeFF | T | S | D | EtBip | MeLys(C12) | # | | | | | | | | | | | | | | | | | | |
| EU-A1090 | 698 | H | Aib | Q | G | T | αMeFF | T | S | D | EtBip | MeLys(C14) | # | | | | | | | | | | | | | | | | | | |
| EU-A1091 | 699 | H | Aib | Q | G | T | αMeFF | T | S | D | EtBip | MeLys(C16) | # | | | | | | | | | | | | | | | | | | |
| EU-A1092 | 700 | H | Aib | Q | G | T | αMeFF | T | S | D | EtBip | MeLys(C18) | # | | | | | | | | | | | | | | | | | | |
| EU-A1093 | 701 | H | Aib | Q | G | T | αMeFF | T | S | D | EtBip | MeLys(C20) | # | | | | | | | | | | | | | | | | | | |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A1094 | 702 | H | αMePro | Q | G | T | αMeF | T | S | D | EtBip | Me8 | # | | | | | | | | | | | | | | | | | | |
| EU-A1095 | 703 | H | αMePro | Q | G | T | αMeF | T | S | D | EtBip | Me12 | # | | | | | | | | | | | | | | | | | | |
| EU-A1096 | 704 | H | αMePro | Q | G | T | αMeF | T | S | D | EtBip | Me14 | # | | | | | | | | | | | | | | | | | | |
| EU-A1097 | 705 | H | αMePro | Q | G | T | αMeF | T | S | D | EtBip | Me16 | # | | | | | | | | | | | | | | | | | | |
| EU-A1098 | 706 | H | αMePro | Q | G | T | αMeF | T | S | D | EtBip | Me18 | # | | | | | | | | | | | | | | | | | | |
| EU-A1099 | 707 | H | αMePro | Q | G | T | αMeF | T | S | D | EtBip | Me20 | # | | | | | | | | | | | | | | | | | | |
| EU-A1100 | 708 | H | αMePro | Q | G | T | αMeFF | T | S | D | EtBip | Me8 | # | | | | | | | | | | | | | | | | | | |
| EU-A1101 | 709 | H | αMePro | Q | G | T | αMeFF | T | S | D | EtBip | Me12 | # | | | | | | | | | | | | | | | | | | |
| EU-A1102 | 710 | H | αMePro | Q | G | T | αMeFF | T | S | D | EtBip | Me14 | # | | | | | | | | | | | | | | | | | | |
| EU-A1103 | 711 | H | αMePro | Q | G | T | αMeFF | T | S | D | EtBip | Me16 | # | | | | | | | | | | | | | | | | | | |
| EU-A1104 | 712 | H | αMePro | Q | G | T | αMeFF | T | S | D | EtBip | Me18 | # | | | | | | | | | | | | | | | | | | |
| EU-A1105 | 713 | H | αMePro | Q | G | T | αMeFF | T | S | D | EtBip | Me20 | # | | | | | | | | | | | | | | | | | | |
| EU-A1106 | 714 | H | Aib | Q | G | T | αMeF | T | S | D | EtBip | Me8 | # | | | | | | | | | | | | | | | | | | |
| EU-A1107 | 715 | H | Aib | Q | G | T | αMeF | T | S | D | EtBip | Me12 | # | | | | | | | | | | | | | | | | | | |
| EU-A1108 | 716 | H | Aib | Q | G | T | αMeF | T | S | D | EtBip | Me14 | # | | | | | | | | | | | | | | | | | | |
| EU-A1109 | 717 | H | Aib | Q | G | T | αMeF | T | S | D | EtBip | Me16 | # | | | | | | | | | | | | | | | | | | |
| EU-A1110 | 718 | H | Aib | Q | G | T | αMeF | T | S | D | EtBip | Me18 | # | | | | | | | | | | | | | | | | | | |
| EU-A1111 | 719 | H | Aib | Q | G | T | αMeFF | T | S | D | EtBip | Me20 | # | | | | | | | | | | | | | | | | | | |
| EU-A1112 | 720 | H | Aib | Q | G | T | αMeFF | T | S | D | EtBip | Me8 | # | | | | | | | | | | | | | | | | | | |
| EU-A1113 | 721 | H | Aib | Q | G | T | αMeFF | T | S | D | EtBip | Me12 | # | | | | | | | | | | | | | | | | | | |
| EU-A1114 | 722 | H | Aib | Q | G | T | αMeFF | T | S | D | EtBip | Me14 | # | | | | | | | | | | | | | | | | | | |
| EU-A1115 | 723 | H | Aib | Q | G | T | αMeFF | T | S | D | EtBip | Me16 | # | | | | | | | | | | | | | | | | | | |
| EU-A1116 | 724 | H | Aib | Q | G | T | αMeFF | T | S | D | EtBip | Me18 | # | | | | | | | | | | | | | | | | | | |
| EU-A1117 | 725 | H | Aib | Q | G | T | αMeFF | T | S | D | EtBip | Me20 | # | | | | | | | | | | | | | | | | | | |
| EU-A1118 | 726 | H | αMePro | Q | G | T | αMeF | T | S | D | Bip | MeLys(C8) | # | | | | | | | | | | | | | | | | | | |
| EU-A1119 | 727 | H | αMePro | Q | G | T | αMeF | T | S | D | Bip | MeLys(C12) | # | | | | | | | | | | | | | | | | | | |
| EU-A1120 | 728 | H | αMePro | Q | G | T | αMeF | T | S | D | Bip | MeLys(C14) | # | | | | | | | | | | | | | | | | | | |
| EU-A1121 | 729 | H | αMePro | Q | G | T | αMeF | T | S | D | Bip | MeLys(C16) | # | | | | | | | | | | | | | | | | | | |
| EU-A1122 | 730 | H | αMePro | Q | G | T | αMeF | T | S | D | Bip | MeLys(C18) | # | | | | | | | | | | | | | | | | | | |
| EU-A1123 | 731 | H | αMePro | Q | G | T | αMeF | T | S | D | Bip | MeLys(C20) | # | | | | | | | | | | | | | | | | | | |
| EU-A1124 | 732 | H | αMePro | Q | G | T | αMeFF | T | S | D | Bip | MeLys(C8) | # | | | | | | | | | | | | | | | | | | |
| EU-A1125 | 733 | H | αMePro | Q | G | T | αMeFF | T | S | D | Bip | MeLys(C12) | # | | | | | | | | | | | | | | | | | | |
| EU-A1126 | 734 | H | αMePro | Q | G | T | αMeFF | T | S | D | Bip | MeLys(C14) | # | | | | | | | | | | | | | | | | | | |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A1127 | 735 | H | αMePro | Q | G | T | αMeFF | T | S | D | Bip | MeLys(C16) | # | | | | | | | | | | | | | | | | | | |
| EU-A1128 | 736 | H | αMePro | Q | G | T | αMeFF | T | S | D | Bip | MeLys(C18) | # | | | | | | | | | | | | | | | | | | |
| EU-A1129 | 737 | H | αMePro | Q | G | T | αMeFF | T | S | D | Bip | MeLys(C20) | # | | | | | | | | | | | | | | | | | | |
| EU-A1130 | 738 | H | Aib | Q | G | T | αMeF | T | S | D | Bip | MeLys(C8) | # | | | | | | | | | | | | | | | | | | |
| EU-A1131 | 739 | H | Aib | Q | G | T | αMeF | T | S | D | Bip | MeLys(C12) | # | | | | | | | | | | | | | | | | | | |
| EU-A1132 | 740 | H | Aib | Q | G | T | αMeF | T | S | D | Bip | MeLys(C14) | # | | | | | | | | | | | | | | | | | | |
| EU-A1133 | 741 | H | Aib | Q | G | T | αMeF | T | S | D | Bip | MeLys(C16) | # | | | | | | | | | | | | | | | | | | |
| EU-A1134 | 742 | H | Aib | Q | G | T | αMeF | T | S | D | Bip | MeLys(C18) | # | | | | | | | | | | | | | | | | | | |
| EU-A1135 | 743 | H | Aib | Q | G | T | αMeF | T | S | D | Bip | MeLys(C20) | # | | | | | | | | | | | | | | | | | | |
| EU-A1136 | 744 | H | Aib | Q | G | T | αMeFF | T | S | D | Bip | MeLys(C8) | # | | | | | | | | | | | | | | | | | | |
| EU-A1137 | 745 | H | Aib | Q | G | T | αMeFF | T | S | D | Bip | MeLys(C12) | # | | | | | | | | | | | | | | | | | | |
| EU-A1138 | 746 | H | Aib | Q | G | T | αMeFF | T | S | D | Bip | MeLys(C14) | # | | | | | | | | | | | | | | | | | | |
| EU-A1139 | 747 | H | Aib | Q | G | T | αMeFF | T | S | D | Bip | MeLys(C16) | # | | | | | | | | | | | | | | | | | | |
| EU-A1140 | 748 | H | Aib | Q | G | T | αMeFF | T | S | D | Bip | MeLys(C18) | # | | | | | | | | | | | | | | | | | | |
| EU-A1141 | 749 | H | Aib | Q | G | T | αMeFF | T | S | D | Bip | MeLys(C20) | # | | | | | | | | | | | | | | | | | | |
| EU-A1142 | 750 | H | αMePro | Q | G | T | αMeF | T | S | D | Bip | Me8 | # | | | | | | | | | | | | | | | | | | |
| EU-A1143 | 751 | H | αMePro | Q | G | T | αMeF | T | S | D | Bip | Me12 | # | | | | | | | | | | | | | | | | | | |
| EU-A1144 | 752 | H | αMePro | Q | G | T | αMeF | T | S | D | Bip | Me14 | # | | | | | | | | | | | | | | | | | | |
| EU-A1145 | 753 | H | αMePro | Q | G | T | αMeF | T | S | D | Bip | Me16 | # | | | | | | | | | | | | | | | | | | |
| EU-A1146 | 754 | H | αMePro | Q | G | T | αMeF | T | S | D | Bip | Me18 | # | | | | | | | | | | | | | | | | | | |
| EU-A1147 | 755 | H | αMePro | Q | G | T | αMeF | T | S | D | Bip | Me20 | # | | | | | | | | | | | | | | | | | | |
| EU-A1148 | 756 | H | αMePro | Q | G | T | αMeFF | T | S | D | Bip | Me8 | # | | | | | | | | | | | | | | | | | | |
| EU-A1149 | 757 | H | αMePro | Q | G | T | αMeFF | T | S | D | Bip | Me12 | # | | | | | | | | | | | | | | | | | | |
| EU-A1150 | 758 | H | αMePro | Q | G | T | αMeFF | T | S | D | Bip | Me14 | # | | | | | | | | | | | | | | | | | | |
| EU-A1151 | 759 | H | αMePro | Q | G | T | αMeFF | T | S | D | Bip | Me16 | # | | | | | | | | | | | | | | | | | | |
| EU-A1152 | 760 | H | αMePro | Q | G | T | αMeFF | T | S | D | Bip | Me18 | # | | | | | | | | | | | | | | | | | | |
| EU-A1153 | 761 | H | αMePro | Q | G | T | αMeFF | T | S | D | Bip | Me20 | # | | | | | | | | | | | | | | | | | | |
| EU-A1154 | 762 | H | Aib | Q | G | T | αMeF | T | S | D | Bip | Me8 | # | | | | | | | | | | | | | | | | | | |
| EU-A1155 | 763 | H | Aib | Q | G | T | αMeF | T | S | D | Bip | Me12 | # | | | | | | | | | | | | | | | | | | |
| EU-A1156 | 764 | H | Aib | Q | G | T | αMeF | T | S | D | Bip | Me14 | # | | | | | | | | | | | | | | | | | | |
| EU-A1157 | 765 | H | Aib | Q | G | T | αMeF | T | S | D | Bip | Me16 | # | | | | | | | | | | | | | | | | | | |
| EU-A1158 | 766 | H | Aib | Q | G | T | αMeF | T | S | D | Bip | Me18 | # | | | | | | | | | | | | | | | | | | |
| EU-A1159 | 767 | H | Aib | Q | G | T | αMeF | T | S | D | Bip | Me20 | # | | | | | | | | | | | | | | | | | | |

Figure 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A1160 | 768 | H | Aib | Q | G | T | αMeFF | T | S | D | Bip | Me8 | # | | | | | | | | | | | | | | | | | | |
| EU-A1161 | 769 | H | Aib | Q | G | T | αMeFF | T | S | D | Bip | Me12 | # | | | | | | | | | | | | | | | | | | |
| EU-A1162 | 770 | H | Aib | Q | G | T | αMeFF | T | S | D | Bip | Me14 | # | | | | | | | | | | | | | | | | | | |
| EU-A1163 | 771 | H | Aib | Q | G | T | αMeFF | T | S | D | Bip | Me16 | # | | | | | | | | | | | | | | | | | | |
| EU-A1164 | 772 | H | Aib | Q | G | T | αMeFF | T | S | D | Bip | Me18 | # | | | | | | | | | | | | | | | | | | |
| EU-A1165 | 773 | H | Aib | Q | G | T | αMeFF | T | S | D | Bip | Me20 | # | | | | | | | | | | | | | | | | | | |
| EU-A1166 | 798 | H | Aib | Q | G | T | F | T | S | D | Y | S | K | Y | L | D | E* | Q | A | A | K* | E | F | I | Lys(C9) | W | L | L | Q | T | # |
| EU-A1167 | 799 | H | Aib | Q | G | T | F | T | S | D | Y | S | K | Y | L | D | E* | Q | A | A | K* | E | F | I | Lys(C10) | W | L | L | Q | T | # |
| EU-A1168 | 800 | H | Aib | Q | G | T | F | T | S | D | Y | S | K | Y | L | D | E* | Q | A | A | K* | E | F | I | Lys(C11) | W | L | L | Q | T | # |
| EU-A1169 | 801 | H | Aib | Q | G | T | F | T | S | D | Y | S | K | Y | L | D | E* | Q | A | A | K* | E | F | I | Lys(Me*8) | W | L | L | Q | T | # |
| EU-A1170 | 802 | H | Aib | Q | G | T | F | T | S | D | Y | S | K | Y | L | D | E* | Q | A | A | K* | E | F | I | Lys(Me*10) | W | L | L | Q | T | # |
| EU-A1171 | 803 | H | Aib | Q | G | T | F | T | S | D | Y | S | K | Y | L | D | E* | Q | A | A | K* | E | F | I | Lys(Me*12) | W | L | L | Q | T | # |
| EU-A1172 | 804 | H | Aib | Q | G | T | F | T | S | D | Y | S | K | Y | L | D | E* | Q | A | A | K* | E | F | I | Lys(Me*14) | W | L | L | Q | T | # |
| EU-A1173 | 805 | H | Aib | Q | G | T | F | T | S | D | Y | S | K | Y | L | D | E* | Q | A | A | K* | E | F | I | Lys(Me*16) | W | L | L | Q | T | # |
| EU-A1174 | 806 | H | Aib | Q | G | T | F | T | S | D | Y | S | K | Y | L | D | E* | Q | A | A | K* | E | F | I | Lys(Me*18) | W | L | L | Q | T | # |

C with a numeral means 1-alkyl beta-D-glucouronyl acyl group, while the numeral denotes the chain length.

MeLys = C-alpha-methyl-lysine, EtBip = 2'-ethyl-biphenylalanine; αMeF = C-α-methyl-Phe; αMeFF = C-α-methyl-2-fluoro-Phe M is maltoside and Me is melibioside-based surfactant, while the numeral is the carbon chain length of the 1-alkyl substitution. Starred means alpha linked glycoside. For example Me* means alpha- melibioside.

Lys(C12) means N-epsilon-(1'-dodecyl beta-D-glucuronyl)-L-lysine and other C numbers mean the corresponding 1'-alkyl glucoronide. The pair of amino acids E*, K* or K*, E* separated by 4 residues denotes a side chain lactam linkage formed between the side chain functional groups on these amino acids.

# means amide C-terminus.

| | | | | | | | | | | | | | | | | | | | | | | | | | | | | | | | |
|---|---|---|---|---|---|---|---|---|---|---|---|---|---|---|---|---|---|---|---|---|---|---|---|---|---|---|---|---|---|---|---|
| EU-A992 | 600 | H | Aib | Q | G | T | F | T | S | D | Y | S | K | Y | L | D | E* | Q | A | A | K* | E | F | I | Lys(C8) | W | L | L | Q | T | # |
| EU-A1022 | 630 | H | Aib | Q | G | T | F | T | S | D | Y | S | K | Y | L | D | E* | Q | A | A | K* | E | F | I | Lys(Me8) | W | L | L | Q | T | # |
| EU-A1169 | 801 | H | Aib | Q | G | T | F | T | S | D | Y | S | K | Y | L | D | E* | Q | A | A | K* | E | F | I | Lys(Me*8) | W | L | L | Q | T | # |

H-His$^{1}$-Aib-Gln-Gly-Thr-Phe-Thr-Ser-Asp-Tyr$^{10}$-Ser-Lys-Tyr-Leu-Asp-

Glu -Gln-Ala-Ala-Lys$^{20*}$-Glu-Phe-Ile-Lys-Trp-Leu-Leu-Gln-Thr$^{29}$-$NH_2$

| | | | | | | | | | | | | | | | | | | | | | | | | | | | | | | |
|---|---|---|---|---|---|---|---|---|---|---|---|---|---|---|---|---|---|---|---|---|---|---|---|---|---|---|---|---|---|---|
| EU-A992 | 600 | H | Aib | Q | G | T | F | T | S | D | Y | S | K | Y | L | D | E* | Q | A | A | K* | E | F | I | Lys(C8) | W | L | L | Q | T | # |

PEPTIDE PHARMACEUTICALS FOR INSULIN RESISTANCE

CROSS REFERENCE

This application is a continuation of U.S. application Ser. No. 17/349,195, filed 16 Jun. 2021 (now U.S. Pat. No. 11,911,447), which is a division of U.S. application Ser. No. 14/646,264, filed 20 May 2015 (now U.S. Pat. No. 11,065,304), which is a U.S. National Stage Entry of PCT/US2013/071077 filed 20 Nov. 2013, which claims the benefit of U.S. Provisional Patent Application Ser. No. 61/728,649, filed 20 Nov. 2012, all of which are incorporated herein by reference in their entirety.

SEQUENCE LISTING

The instant application contains a Sequence Listing which has been submitted electronically in ASCII format via the USPTO Patent Center and hereby incorporated by reference in its entirety. Said ASCII copy, created on 18 Sep. 2025, is named MED004US3V2.xml and is 2,389,000 bytes in size.

FIELD OF THE INVENTION

The increasing prevalence of diabetes mellitus is a world health crisis of epidemic proportions that is a major contributor to patient morbidity and mortality and a major economic burden. Obesity is an important risk factor for type 2 diabetes mellitus, and roughly 90% of patients with type 2 diabetes are overweight or obese. Obesity is a rapidly increasing problem worldwide and currently more than 65% of adults in the U.S. are overweight (Hedley, A. A., et al. (2004) JAMA 291: 2847-2850). There is a need for development of safe and efficacious pharmaceutical treatments for obesity and diabetes mellitus.

SUMMARY OF THE INVENTION

Described herein are compositions and methods for treatment or prevention of disorders associated with the insulin resistance including and not limited to obesity, Syndrome X, the metabolic syndrome, insulin resistance, type 2 diabetes, hypertension, cardioprotection, atherosclerosis, myocardial infarction, beta cell protection, or the like. In some embodiments, the methods include prophylactic and/or therapeutic treatment with peptides and/or proteins. Native peptides and/or proteins and peptide and/or protein pharmaceuticals often suffer from several limitations in their use in medicine (Nestor, J. J., Jr. (2007) Comprehensive Medicinal Chemistry II 2: 573-601)—such as short duration of action, poor bioavailability, and lack of receptor subtype selectivity. In addition, peptides and/or proteins are unstable in formulations, often being subject to aggregation.

Described herein are certain covalently modified peptides and/or proteins (for example, GLP-1, glucagon, related analogs or the like) that allow for longer duration of action and/or improved bioavailability upon administration of the modified peptides and/or proteins. Such covalently modified peptides and/or proteins are suitable for prevention and/or treatment of conditions associated with obesity, the metabolic syndrome, insulin resistance, type 2 diabetes, hypertension, atherosclerosis, or the like.

In some embodiments, the covalently modified peptides and/or proteins described herein are attached to glycoside surfactants. In one aspect, the covalently modified peptides and/or proteins are attached to a glycoside surfactant wherein the peptide and/or protein is attached to the glycoside in the surfactant and the glycoside is then attached to a hydrophobic group. Also provided herein, in some embodiments, are reagents and intermediates for synthesis of modified peptides and/or proteins (e.g., modified GLP-1, glucagon, oxyntomodulin, analogs of glucagon, oxyntomodulin or GLP-1, other incretins, or the like) through the incorporation of surfactants.

Provided herein, in some embodiments, are peptide products comprising a surfactant X, covalently attached to a peptide, the peptide comprising a linker amino acid U and at least one other amino acid:

Formula I-A

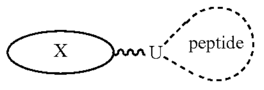

wherein the surfactant X is a group of Formula I:

Formula I

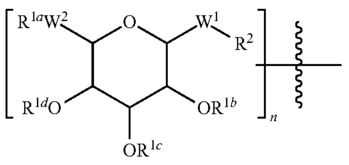

wherein:

$R^{1a}$ is independently, at each occurrence, a bond, H, a protecting group, a substituted or unsubstituted $C_1$-$C_{30}$ alkyl group, a saccharide, a substituted or unsubstituted alkoxyaryl group, or a substituted or unsubstituted aralkyl group;

$R^{1b}$, $R^{1c}$, and $R^{1d}$ are each, independently at each occurrence, a bond, H, a protecting group, a substituted or unsubstituted $C_1$-$C_{30}$ alkyl group, a substituted or unsubstituted alkoxyaryl group, or a substituted or unsubstituted aralkyl group;

$W^1$ is independently, at each occurrence, —$CH_2$—, —$CH_2$—O—, —(C═O), —(C═O)—O—, —(C═O)—NH—, —(C═S)—, —(C═S)—NH—, or —$CH_2$—S—;

$W^2$ is —O—, —$CH_2$— or —S—;

$R^2$ is independently, at each occurrence, a bond, H, a substituted or unsubstituted $C_1$-$C_{30}$ alkyl group, a substituted or unsubstituted alkoxyaryl group, or a substituted or unsubstituted aralkyl group, —$NH_2$, —SH, $C_2$-$C_4$-alkene, $C_2$-$C_4$-alkyne, —NH(C═O)—$CH_2$—Br, —$(CH_2)_m$-maleimide, or —$N_3$;

n is 1, 2 or 3; and m is an integer of 1-10;

the peptide is selected from Formula II:

Formula II (SEQ. ID. NO. 1)

$aa_1$-$aa_2$-$aa_3$-$aa_4$-$aa_5$-$aa_6$-$aa_7$-$aa_8$-$aa_9$-$aa_{10}$-$aa_{11}$-$aa_{12}$-

$aa_{13}$-$aa_{14}$-$aa_{15}$-$aa_{16}$-$aa_{17}$-$aa_{18}$-$aa_{19}$-$aa_{20}$-$aa_{21}$-$aa_{22}$-

$aa_{23}$-$aa_{24}$-$aa_{25}$-$aa_{26}$-$aa_{27}$-$aa_{28}$-$aa_{29}$-$aa_{30}$-$aa_{31}$-$aa_{32}$-

$aa_{33}$-$aa_{34}$-$aa_{35}$-$aa_{36}$-$aa_{37}$-Z wherein:

Z is OH, N—$R^4$-His, or —NH—$R^3$, wherein $R^3$ is H, $C_1$-$C_{12}$ substituted or unsubstituted alkyl, or a PEG chain of less than 10 Da; and $R^4$ is a $C_2$-$C_{10}$ acyl group, for example Ac or Bz;

$aa_1$ is His, N—$R^4$-His, pGlu-His, or N—$R^3$-His;

$aa_2$ is Ser, D-Ser, Ala, Gly, Pro, MePro, Aib, Ac4c, or Ac5c;

$aa_3$ is Gln, or Cit;

$aa_4$ is Gly, or D-Ala;

$aa_5$ is Thr, or Ser;

$aa_6$ is Phe, Trp, 2FPhe, MePhe, 2FMePhe, or Nal2;

$aa_7$ is Thr, or Ser;

$aa_8$ is Ser, or Asp;

$aa_9$ is Asp, or Glu;

$aa_{10}$ is Tyr, Leu, Met, Nal2, Bip, Bip2EtMeO or U;

$aa_{11}$ is absent or Ser, Asn, Bip or U;

$aa_{12}$ is absent or Lys, Glu, Ser, Arg, or U;

$aa_{13}$ is absent or Tyr, Gln, Cit, or U;

$aa_{14}$ is absent or Leu, Met, Nle, or U;

$aa_{15}$ is absent or Asp, Glu, or U;

$aa_{16}$ is absent or Ser, Gly, Glu, Ala, Aib, Ac5c, Lys, Arg, or U;

$aa_{17}$ is absent or Arg, hArg, Gln, Glu, Cit, Aib, Ac4c, Ac5c, Lys, or U;

$aa_{18}$ is absent or Arg, hArg, Ala, Aib, Ac4c, Ac5c, or U;

$aa_{19}$ is absent or Ala, Val, Aib, Ac4c, Ac5c, or U;

$aa_{20}$ is absent or Gln, Lys, Arg, Cit, Glu, Aib, Ac4c, Ac5c, or U;

$aa_{21}$ is absent or Asp, Glu, Leu, Aib, Ac4c, Ac5c, or U;

$aa_{22}$ is absent or Phe, Trp, Nal2, Aib, Ac4c, Ac5c, or U $aa_{23}$ is absent or Val, Ile, Aib, Ac4c, Ac5c, or U;

$aa_{24}$ is absent or Gln, Ala, Glu, Cit, or U;

$aa_{25}$ is absent or Trp, Nal2, or U;

$aa_{26}$ is absent or Leu, or U;

$aa_{27}$ is absent or Met, Val, Leu, Nle, Lys, or U;

$aa_{28}$ is absent or Asn, Lys, Gln, Cit, or U;

$aa_{29}$ is absent or Thr, Gly, Aib, Ac4c, Ac5c, or U;

$aa_{30}$ is absent or Lys, Aib, Ac4c, Ac5c, Arg, or U;

$aa_{31}$ is absent or Arg, Aib, Ac4c, Ac5c, or U;

$aa_{32}$ is absent or Asn, Aib, Ac4c, Ac5c, or U;

$aa_{33}$ is absent or Arg, Aib, Ac4c, Ac5c, or U;

$aa_{34}$ is absent or Asn, Aib, Ac4c, Ac5c, or U;

$aa_{35}$ is absent or Asn, Aib, Ac4c, Ac5c, or U;

$aa_{36}$ is absent or Ile, Ala, Aib, Ac4c, Ac5C, or U;

$aa_{37}$ absent or U;

U is a natural or unnatural amino acid comprising a functional group used for covalent attachment to the surfactant X;

wherein any two of $aa_1$-$aa_{37}$ are optionally cyclized through their side chains to form a lactam linkage; and provided that one, or at least one of $aa_{10}$-$aa_{37}$ is the linker amino acid U covalently attached to X.

In some embodiments, n is 1. In some embodiments, n is 2, and a first glycoside is attached to a second glycoside via bond between $W^2$ of the first glycoside and any one of $OR^{1b}$, $OR^{1c}$ or $OR^{1d}$ of the second glycoside. In some embodiments, n is 3, and a first glycoside is attached to a second glycoside via bond between $W^2$ of the first glycoside and any one of $OR^{1b}$, $OR^{1c}$ or $OR^{1d}$ of the second glycoside, and the second glycoside is attached to a third glycoside via bond between $W^2$ of the second glycoside and any one of $OR^{1b}$, $OR^{1c}$ or $OR^{1d}$ of the third glycoside.

In one embodiment, compounds of Formula I-A are compounds wherein X has the structure:

Formula I

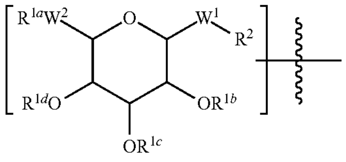

wherein:

$R^{1a}$ is H, a protecting group, a saccharide, a substituted or unsubstituted $C_1$-$C_{30}$ alkyl group, or a steroid nucleus containing moiety;

$R^{1b}$, $R^{1c}$, and $R^{1d}$ are each, independently at each occurrence, H, a protecting group, or a substituted or unsubstituted $C_1$-$C_{30}$ alkyl group;

$W^1$ is independently, at each occurrence, —$CH_2$—, —$CH_2$—O—, —(C═O), —(C═O)—O—, —(C═O)—NH—, —(C═S)—, —(C═S)—NH—, or —$CH_2$—S—;

$W^2$ is —O—, —S—;

$R^2$ is a bond, $C_2$-$C_4$-alkene, $C_2$-$C_4$-alkyne, or —$(CH_2)_m$-maleimide; and m is 1-10.

In another embodiment, compounds of Formula I-A are compounds wherein X has the structure:

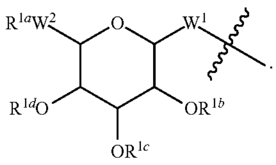

Accordingly, in the embodiment described above, $R^2$ is a bond.

For instance, in an exemplary embodiment of the structure of X described above, $W^1$ is —C(═O)NH—, $R^2$ is a bond between $W^1$ and an amino acid residue U within the peptide (e.g., an amino group in the sidechain of a lysine residue present in the peptide).

In a further embodiment, compounds of Formula I-A are compounds wherein X has the structure:

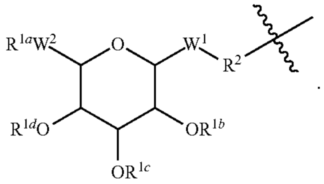

For instance, in an exemplary embodiment of the structure of X described above, $W^1$ is —$CH_2$— and $R^2$ is an alkyl-linked maleimide functional group on X and $R^2$ is attached to a suitable moiety of an amino acid residue U within the peptide (e.g., a thiol group in a cysteine residue of the peptide forms a thioether with the maleimide on X).

In yet another embodiment, compounds of Formula I-A are compounds wherein X has the structure:

Formula I

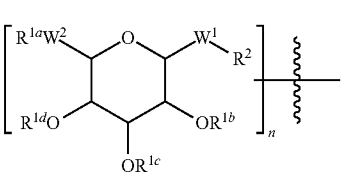

wherein:

$R^{1a}$ is H, a protecting group, a saccharide, a substituted or unsubstituted $C_1$-$C_{30}$ alkyl group, or a steroid nucleus containing moiety;

$R^{1b}$, $R^{1c}$, and $R^{1d}$ are each, independently at each occurrence, H, a protecting group, or a substituted or unsubstituted $C_1$-$C_{30}$ alkyl group;

$W^1$ is —(C═O)—NH—;

$W^2$ is —O—;

$R^2$ is a bond.

In an additional embodiment, compounds of Formula I-A are compounds wherein X has the structure:

Formula I

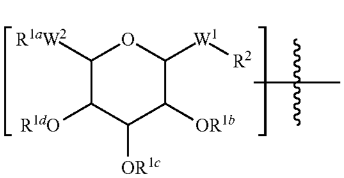

wherein:

$R^{1a}$ is a substituted or unsubstituted $C_1$-$C_{30}$ alkyl group;

$R^{1b}$, $R^{1c}$, and $R^{1d}$ are H;

$W^1$ is —(C═O)—NH—;

$W^2$ is —O—; and $R^2$ is a bond.

In some embodiments described above and herein, $R^{1a}$ is a substituted or unsubstituted $C_1$-$C_{30}$ alkyl group.

In some embodiments described above and herein, $R^{1a}$ is a substituted or unsubstituted $C_6$-$C_{20}$ alkyl group.

In some embodiments described above and herein, $R^{1a}$ is a saccharide. In some embodiments, the saccharide is a galactose. In certain embodiments, the saccharide is an alpha-linked galactose. In other embodiments, the saccharide is alpha-linked galactopyranose, beta-linked galactopyranose, alpha-linked galactofuranose, or beta-linked galactofuranose.

Also contemplated herein are alternate embodiments wherein X in Formula I-A has the structure:

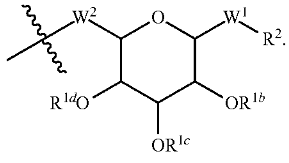

For instance, in an exemplary embodiment of the structure of X described above, $W^1$ is —S—, $R^2$ is a $C_1$-$C_{30}$ alkyl group, $W^2$ is S, $R^{1a}$ is a bond between $W^2$ and a suitable moiety of an amino acid residue U within the peptide (e.g., a thiol group in a cysteine residue of the peptide forms a thioether with X).

In another exemplary embodiment of the structure of X described above, $W^1$ is —O—, $R^2$ is a $C_1$-$C_{30}$ alkyl group, $W^2$ is O, $R^{1a}$ is a bond between $W^2$ and a suitable moiety of an amino acid residue U within the peptide (e.g., a hydroxyl group in a serine or threonine residue of the peptide forms an ether with X).

In some embodiments, U is used for covalent attachment to X and is a dibasic natural or unnatural amino acid, a natural or unnatural amino acid comprising a thiol, an unnatural amino acid comprising a —$N_3$ group, an unnatural amino acid comprising an acetylenic group, or an unnatural amino acid comprising a —NH—C(═O)—$CH_2$—Br or a —$(CH_2)$m-maleimide, wherein m is 1-10.

In some embodiments of the peptide product, the surfactant is a 1-alkyl glycoside class surfactant. In some embodiments of the peptide product, the surfactant is attached to the peptide via an amide bond.

In some embodiments of the peptide product, the surfactant X comprises 1-eicosyl beta-D-glucuronic acid, 1-octadecyl beta-D-glucuronic acid, 1-hexadecyl beta-D-glucuronic acid, 1-tetradecyl beta-D-glucuronic acid, 1-dodecyl beta D-glucuronic acid, 1-decyl beta-D-glucuronic acid, 1-octyl beta-D-glucuronic acid, 1-eicosyl beta-D-diglucuronic acid, 1-octadecyl beta-D-diglucuronic acid, 1-hexadecyl beta-D-diglucuronic acid, 1-tetradecyl beta-D-diglucuronic acid, 1-dodecyl beta-D-diglucuronic acid, 1-decyl beta-D-diglucuronic acid, 1-octyl beta-D-diglucuronic acid, or functionalized 1-eicosyl beta-D-glucose, 1-octadecyl beta-D-glucose, 1-hexadecyl beta-D-glucose, 1-tetradecyl beta-D-glucose, 1-dodecyl beta-D-glucose, 1-decyl beta-D-glucose, 1-octyl beta-D-glucose, 1-eicosyl beta-D-maltoside, 1-octadecyl beta-D-maltoside, 1-hexadecyl beta-D-maltoside, 1-tetradecyl beta-D-maltoside, 1-dodecyl beta-D-maltoside, 1-decyl beta-D-maltoside, 1-octyl beta-D-maltoside, 1-eicosyl beta-D-melibioside, 1-octadecyl beta-D-melibioside, 1-hexadecyl beta-D-melibioside, 1-tetradecyl beta-D-melibioside, 1-dodecyl beta-D-melibioside, 1-decyl beta-D-melibioside, 1-octyl beta-D-melibioside and the like, as well as the corresponding 6' or 6',6 carboxylic acids and the peptide product is prepared by formation of a linkage between the aforementioned groups and a group on the peptide (e.g., a —COOH group in the aforementioned groups and an amino group of the peptide). In some embodiments, the surfactant X is 1-tetradecyl beta-D-maltoside, 1-dodecyl beta-D-maltoside, 1-decyl beta-D-maltoside, 1-octyl beta-D-maltoside, 1-eicosyl beta-D-melibioside, 1-octadecyl beta-D-melibioside, 1-hexadecyl beta-D-melibioside, 1-tetradecyl beta-D-melibioside, 1-dodecyl beta-D-melibioside, 1-decyl beta-D-melibioside, or 1-octyl beta-D-melibioside, as well as the corresponding 6' or 6',6 carboxylic acids. In some embodiments, the surfactant X is 1-tetradecyl beta-D-maltoside, 1-eicosyl beta-D-melibioside, 1-octadecyl beta-D-melibioside, 1-hexadecyl beta-D-melibioside, 1-tetradecyl beta-D-melibioside, 1-dodecyl beta-D-melibioside, 1-decyl beta-D-melibioside, or 1-octyl beta-D-melibioside.

In some embodiments of the peptide product, U is a terminal amino acid of the peptide. In some embodiments of the peptide product, U is a non-terminal amino acid of the peptide. In some embodiments of the peptide product, U is a natural D- or L-amino acid. In some embodiments of the peptide product, U is an unnatural amino acid. In some embodiments of the peptide product, U is selected from Lys, Cys, Orn, or an unnatural amino acid comprising a functional group used for covalent attachment to the surfactant X.

In some embodiments of the peptide product, the functional group used for covalent attachment of the peptide to the surfactant X is —$NH_2$, —SH, —OH, —$N_3$, haloacetyl, a —$(CH_2)_m$-maleimide (wherein m is 1-10), or an acetylenic group.

In some embodiments side chain functional groups of two different amino acid residues are linked to form a cyclic lactam. This linkage is denoted with an asterisk on the two residues so linked. For example, in some embodiments, a Lys* side chain forms a cyclic lactam with the side chain of Glu*. In some embodiments such lactam structures are reversed and are formed from a Glu* and a Lys*. Such lactam linkages in some instances are known to stabilize alpha helical structures in peptides (Condon, S. M., et al. (2002) Bioorg Med Chem 10: 731-736; Murage, E. N., et al (2008) Bioorg Med Chem 16: 10106-12); Murage, E. N., et al. (2010) J Med Chem 53: 6412-20). In some embodiments cysteine residues may be linked through disulfide formation in order to accomplish a similar form of conformational restriction and assist in the formation of helical structures (Li, Y., et al. (2011) Peptides 32: 1400-1407). In some embodiments side chain functional groups of two different amino acid residues are linked to form a heterocycle generated through a "click reaction" between side chain azide and alkyne functional groups in order to achieve a similar form of conformational restriction and stabilized helical conformations (Le Chevalier Isaad A., et al. (2009) J Peptide Sci 15: 451-4). In some embodiments side chain functional groups of two different amino acid residues are linked to form a C—C double bond through the use of an olefin metathesis reaction and may be further modified by reduction to a C—C single bond (Verdine, G. L. and Hilinski, G. J. (2011) Meth Enzymol 503: 3-33).

In some embodiments, the peptide product comprising a covalently linked alkyl glycoside is a covalently modified glucagon or analog thereof. In some of such embodiments, the peptide product contains a covalently linked 1-O-alkyl β-D-glucuronic acid and the peptide is an analog of glucagon.

In some embodiments, a peptide product comprising a covalently linked alkyl glycoside is a covalently modified GLP-1, or analog thereof. In some of such embodiments, the peptide product comprises a covalently linked 1-O-alkyl β-D-glucuronic acid and the peptide is an analog of GLP-1.

In some embodiments, the peptide product of Formula I-A has the structure of Formula III-A

```
Formula III-A
                                        (SEQ. ID. NO. 2)
```

$aa_1$-$aa_2$-$aa_3$-$aa_4$-$aa_5$-$aa_6$-$aa_7$-$aa_8$-$aa_9$-$aa_{10}$-$aa_{11}$-$aa_{12}$-$aa_{13}$-$aa_{14}$-$aa_{15}$-$aa_{16}$-$aa_{17}$-$aa_{18}$-$aa_{19}$-$aa_{20}$-$aa_{21}$-$aa_{22}$-$aa_{23}$-$aa_{24}$-$aa_{25}$-$aa_{26}$-$aa_{27}$-$aa_{28}$-$aa_{29}$-Z wherein:

Z is OH, or —NH—$R^3$, wherein $R^3$ is H, or $C_1$-$C_{12}$ substituted or unsubstituted alkyl, or a PEG chain of less than 10 Da;

$aa_1$ is His, N—Ac-His, pGlu-His, or N—$R^3$-His;

$aa_2$ is Ser, Ala, Gly, MePro, Aib, Ac4c, or Ac5c;

$aa_3$ is Gln, or Cit;

$aa_4$ is Gly, or D-Ala;

$aa_5$ is Thr, or Ser;

$aa_6$ is Phe, Trp, 2FPhe, MePhe, 2FMePhe, or Nal2;

$aa_7$ is Thr, or Ser;

$aa_8$ is Ser, or Asp;

$aa_9$ is Asp, or Glu;

$aa_{10}$ is Tyr, Leu, Met, Nal2, Bip, Bip2EtMeO or U(X);

$aa_{11}$ is absent or Ser, Asn, Bip or U(X);

$aa_{12}$ is absent or Lys, Glu, Ser, Arg, or U(X);

$aa_{13}$ is absent or Tyr, Gln, Cit, or U(X);

$aa_{14}$ is absent or Leu, Met, Nle, or U(X);

$aa_{15}$ is absent or Asp, Glu, or U(X);

$aa_{16}$ is absent or Ser, Gly, Glu, Ala, Aib, Ac5c, Lys, Arg, or U(X);

$aa_{17}$ is absent or Arg, hArg, Gln, Glu, Lys, Cit, Aib, Ac4c, Ac5c, or U(X);

$aa_{18}$ is absent or Arg, hArg, Ala, Aib, Ac4c, Ac5c, or U(X);

$aa_{19}$ is absent or Ala, Val, Aib, Ac4c, Ac5c, or U(X);

$aa_{20}$ is absent or Gln, Lys, Arg, Cit, Glu, Aib, Ac4c, Ac5c, or U(X);

$aa_{21}$ is absent or Asp, Glu, Leu, Aib, Ac4c, Ac5c, or U(X);

$aa_{22}$ is absent or Phe, Trp, Nal2, Aib, Ac4c, Ac5c, or U(X);

$aa_{23}$ is absent or Val, Ile, Aib, Ac4c, Ac5c, or U(X);

$aa_{24}$ is absent or Gln, Ala, Glu, Cit, or U(X);

$aa_{25}$ is absent or Trp, Nal2, or U(X);

$aa_{26}$ is absent or Leu, or U(X);

$aa_{27}$ is absent or Met, Val, Leu, Nle, Lys, or U(X);

$aa_{28}$ is absent or Asn, Lys, Gln, or U(X);

$aa_{29}$ is absent or Thr, Gly, Aib, Ac4c, Ac5c, or U(X);

wherein any two of $aa_1$-$aa_{29}$ are optionally cyclized through their side chains to form a lactam linkage; and provided that one, or at least one of $aa_{10}$, $aa_{11}$, $aa_{12}$, $aa_{16}$, $aa_{17}$, $aa_{18}$, $aa_{19}$, $aa_{20}$, $aa_{21}$, $aa_{22}$, $aa_{23}$, $aa_{24}$, $aa_{25}$, $aa_{26}$, $aa_{27}$, $aa_{28}$ or $aa_{29}$ is the natural or unnatural amino acid U covalently attached to X.

In some embodiments, the peptide product of Formula I-A has the structure of Formula III-B:

```
Formula III-B
                                        (SEQ. ID. NO. 3)
```

$His_1$-$aa_2$-$aa_3$-$Gly_4$-$Thr_5$-$aa_6$-$Thr_7$-$Ser_8$-$Asp_9$-$aa_{10}$-$aa_{11}$-$aa_{12}$-$aa_{13}$-$aa_{14}$-$aa_{15}$-$aa_{16}$-$aa_{17}$-$aa_{18}$-$aa_{19}$-$aa_{20}$-$aa_{21}$-$aa_{22}$-$aa_{23}$-$aa_{24}$-$aa_{25}$-$aa_{26}$-$aa_{27}$-$aa_{28}$-$aa_{29}$-$aa_{30}$-Z wherein:

Z is OH, or —NH—$R^3$, wherein $R^3$ is H, substituted or unsubstituted $C_1$-$C_{12}$ alkyl, or a PEG chain of less than 10 Da;

$aa_2$ is Gly, MePro or Aib;

$aa_3$ is Gln or Cit;

$aa_6$ is Phe, 2FPhe, MePhe, 2FMePhe, or Nal2;

$aa_{10}$ is Tyr, Nal2, Bip, Bip2EtMeO or U(X);

$aa_{11}$ is absent or Ser, Asn, Bip or U(X);

$aa_{12}$ is absent or Lys, Glu, Ser or U(X);

$aa_{13}$ is absent or Tyr, Gln, Cit, or U(X);

$aa_{14}$ is absent or Leu, Nle, or U(X);

$aa_{15}$ is absent or Asp, Glu, or U(X);

$aa_{16}$ is absent or Ser, Gly, Glu, Ala, Aib, Lys, Arg, or U(X);

$aa_{17}$ is absent or Arg, hArg, Gln, Glu, Lys, Cit, Aib, or U(X);

$aa_{18}$ is absent or Arg, hArg, Ala, Aib, Ac4c, Ac5c, or U(X);

$aa_{19}$ is absent or Ala, Aib, or U(X);

$aa_{20}$ is absent or Gln, Lys, Arg, Cit, Glu, Aib, or U(X);

$aa_{21}$ is absent or Asp, Glu, Leu, Aib, or U(X);

$aa_{22}$ is absent or Phe, or U(X)

$aa_{23}$ is absent or Val, Ile, Aib or U(X);

$aa_{24}$ is absent or Ala, Gln or U(X);

$aa_{25}$ is absent or Trp or U(X);

$aa_{26}$ is absent or Len or U(X);

$aa_{27}$ is absent or Met, Val, Leu, Nle, Lys or U(X);

$aa_{28}$ is absent or Asn, Gln, Cit, or U(X);

$aa_{29}$ is absent or Thr, Aib, or U(X);

$aa_{30}$ is absent or Arg, or U(X);

wherein any two of $aa_1$-$aa_{23}$ are optionally cyclized through their side chains to form a lactam linkage; and provided that one, or at least one of $aa_{10}$, $aa_{11}$, $aa_{12}$, $aa_{16}$, $aa_{17}$, $aa_{18}$, $aa_{19}$, $aa_{20}$, $aa_{21}$, $aa_{22}$, $aa_{23}$, $aa_{24}$, or $aa_{28}$ is the natural or unnatural amino acid U covalently attached to X.

In some embodiments of Formula I-A, III-A, or III-B, U is any linker amino acid described herein.

In some embodiments of Formula I-A, III-A, or III-B, $aa_{12}$ is lysine. In some embodiments of Formula I-A, III-A, or III-B, $aa_{14}$ is leucine.

In some embodiments of Formula I-A, III-A, or III-B, $aa_{18}$ is a lysine residue attached to X.

In some embodiments of Formula I-A, III-A, or III-B, $aa_{17}$ is a homo Arginine (hArg) residue.

In some embodiments of Formula I-A, III-A, or III-B, $aa_{17}$ is a glycine residue.

In some embodiments of Formula I-A, III-A, or III-B, $aa_2$ is an Aib or Ac4c residue. In some embodiments, $aa_2$ is an Aib residue.

In some embodiments of Formula I-A, III-A, or III-B, the peptide comprises one or more Aib residues.

In some embodiments of Formula I-A, III-A, or III-B, peptide comprises one or more Aib residues at the C-terminus.

In some embodiments of Formula I-A, III-A, or III-B, the peptide product has the structure:

(SEQ. ID. NO. 774)

$His_1$-$aa_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$aa_{16}$-$aa_{17}$-$Ala_{18}$-$Ala_{19}$-$aa_{20}$-$Glu_{21}$-$Phe_{22}$-$aa_{23}$-$aa_{24}$-$Trp_{25}$-$Leu_{26}$-$aa_{27}$-$aa_{28}$-$Thr_{29}$-$NH_2$;

wherein $aa_2$ is Gly or Aib;

$aa_{16}$ is Glu, Ser, Ala, Lys, or Aib;

$aa_{17}$ is Gln, Lys or U(X);

$aa_{20}$ is Lys, Glu or Arg;

$aa_{23}$ is Ile or Val;

$aa_{24}$ is Ala or U(X);

$aa_{27}$ is Met, Val or Leu;

$aa_{28}$ is Asn, Gln or U(X).

In some embodiments of Formula I-A, III-A, or III-B, the peptide product has the structure:

(SEQ. ID. NO. 775)

$His_1$-$aa_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$aa_{16}$-$aa_{17}$-$Ala_{18}$-$Ala_{19}$-$Lys_{20}$-$Glu_{21}$-$Phe_{22}$-$Ile_{23}$-$Ala_{24}$-$Trp_{25}$-$Leu_{26}$-$Leu_{27}$-$Asn_{28}$-$Thr_{29}$-$NH_2$;

wherein $aa_2$ is Gly or Aib;

$aa_{16}$ is Glu, Ala, Aib;

$aa_{17}$ is Lys or U(X);

$aa_{27}$ is Leu or Val.

In some embodiments of Formula I-A, III-A, or III-B, the peptide product has the structure:

(SEQ. ID. NO. 776)

$His_1$-$aa_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$aa_{16}$-$aa_{17}$-$Arg_{18}$-$Ala_{19}$-$aa_{20}$-$Asp_{21}$-$Phe_{22}$-$aa_{23}$-$aa_{24}$-$Trp_{25}$-$Leu_{26}$-$aa_{27}$-$aa_{28}$-$Thr_{29}$-$NH_2$;

wherein $aa_2$ is Gly or Aib;

$aa_{16}$ is Glu, Ser, Ala, or Aib;

$aa_{17}$ is Arg, hArg, or Gln, $aa_{20}$ is Lys or U(X);

$aa_{23}$ is Ile or Val;

$aa_{24}$ is Gln, Ala, or U(X);

$aa_{27}$ is Len or Val; and $aa_{28}$ is Asn, Gln, or U(X).

In some embodiments of Formula I-A, III-A, or III-B, the peptide product has the structure:

(SEQ. ID. NO. 777)

$His_1$-$aa_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$aa_{16}$-$aa_{17}$-$Arg_{18}$-$Ala_{19}$-$aa_{20}$-$Asp_{21}$-$Phe_{22}$-$aa_{23}$-$aa_{24}$-$Trp_{25}$-$Leu_{26}$-$aa_{27}$-$aa_{28}$-$Thr_{29}$-$NH_2$;

wherein $aa_2$ is Gly or Aib;

$aa_{16}$ is Glu, Ser, Ala, Aib;

$aa_{17}$ is Arg, hArg or Gln, $aa_{20}$ is Lys or U(X);

$aa_{23}$ is Ile or Val;

$aa_{24}$ is Gln, Ala or U(X);

$aa_{27}$ is Leu or Val;

$aa_{28}$ is Asn, Gln or U(X).

In some embodiments of Formula I-A, III-A, or III-B, the peptide product has the structure:

(SEQ. ID. NO. 778)

$His_1$-$aa_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$aa_{16}$-$aa_{17}$ $Ala_{18}$-$Ala_{19}$-

-continued $aa_{20}$-$Glu_{21}$-$Phe_{22}$-$Ile_{23}$-Lys(N-omega-X)$_{24}$-$Trp_{25}$-$Leu_{26}$-$aa_{27}$-$aa_{28}$-$Thr_{29}$-$NH_2$;

wherein $aa_2$ is Aib or Gly;

$aa_{16}$ and $aa_{20}$ are each individually either Lys or Glu and are cyclized through their side chains to form a lactam linkage;

$aa_{17}$ is Arg, hArg or Gln;

$aa_{27}$ is Met, Val, Leu or Nle;

$aa_{28}$ is Asn or Gln; and alkyl is a $C_8$-$C_{20}$ linear alkyl chain.

In some embodiments, Lys(N-omega-X)$_{24}$ is Lys(N-omega-1'-alkyl beta-D-glucuronyl).

In some embodiments of Formula I-A, III-A, or III-B, the peptide product has the structure:

(SEQ. ID. NO. 779)

$His_1$-$aa_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$aa_{16}$-$aa_{17}$ $Ala_{18}$-$Ala_{19}$-$Lys_{20}$-$Glu_{21}$-$Phe_{22}$-$Ile_{23}$-$Ala_{24}$-$Trp_{25}$-$Leu_{26}$-$Leu_{27}$-$Asn_{28}$-$Thr_{29}$-$NH_2$;

wherein $aa_2$ is Aib or Gly;

$aa_{16}$ is Glu, Ala or Aib;

$aa_{17}$ is Lys or Lys(N-omega-X);

and alkyl is a $C_8$-$C_{20}$ linear alkyl chain.

In some embodiments, $aa_{17}$ is Lys(N-omega-1'-alkyl beta-D-glucuronyl).

In some embodiments of Formula I-A, III-A, or III-B, the peptide product has the structure:

(SEQ. ID. NO. 780)

$His_1$-$aa_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$aa_{16}$-$aa_{17}$-$Arg_{18}$-$Ala_{19}$-$aa_{20}$-$Asp_{21}$-$Phe_{22}$-$aa_{23}$-$aa_{24}$-$Trp_{25}$-$Leu_{26}$-$aa_{27}$-$aa_{28}$-$Thr_{29}$-$NH_2$;

wherein $aa_2$ is Gly or Aib;

$aa_{16}$ is Glu, Ala, Aib;

$aa_{17}$ is Arg, hArg;

$aa_{20}$ is Lys or Lys(N-omega-X);

$aa_{23}$ is Ile or Val;

$aa_{24}$ is Gln or Ala;

$aa_{27}$ is Len or Val;

$aa_{28}$ is Asn or Gln;

and alkyl is a $C_8$-$C_{20}$ linear alkyl chain.

In some embodiments, $aa_{20}$ is Lys(N-omega-1'-alkyl beta-D-glucuronyl).

In some embodiments of Formula I-A, III-A, or III-B, the peptide product has the structure:

(SEQ. ID. NO. 781)

$His_1$-$aa_2$-$Gln_3$-$Gly_4$-$Thr_5$-$aa_6$-$Thr_7$-$Ser_8$-$Asp_9$-$aa_{10}$-$aa_{11}$-Z;

wherein $aa_2$ is Gly, Aib or MePro;

$aa_6$ is Phe, 2FPhe, MePhe or 2FMePhe;

$aa_{10}$ is Tyr, Nal2, Bip, Bip2Et or Bip2EtMeO;

$aa_{11}$ is Lys or Lys(N-omega-X);

and alkyl is a $C_8$-$C_{20}$ linear alkyl chain.

In some embodiments, $aa_{11}$ is Lys(N-omega-1'-alkyl beta-D-glucuronyl).

In some embodiments of Formula I-A, III-A, or III-B, the peptide product has the structure:

(SEQ. ID. NO. 795)

$His_1$-$aa_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu_{16}$-U(X)$_{17}$-$Ala_{18}$-$Ala_{19}$-$Lys_{20}$-$Glu_{21}$-$Phe_{22}$-$Ile_{23}$-$Ala_{24}$-$Trp_{25}$-$Leu_{26}$-$Leu_{27}$-$aa_{28}$-$Thr_{29}$-$NH_2$;

wherein $aa_2$ is Gly or Aib;

$aa_{28}$ is Asn or Gln.

In some embodiments of Formula I-A, III-A, or III-B, the peptide product has the structure:

(SEQ. ID. NO. 796)

$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$aa_{16}$-$Gln_{17}$ $Ala_{18}$-$Ala_{19}$-$aa_{20}$-$Glu_{21}$-$Phe_{22}$-$Ile_{23}$-Lys(N-omega-X)$_{24}$-$Trp_{25}$-$Leu_{26}$-$Leu_{27}$-$aa_{28}$-$Thr_{29}$-$NH_2$;

wherein $aa_{16}$ and $aa_{20}$ are each individually either Lys or Glu and are cyclized through their side chains to form a lactam linkage;

and $aa_{28}$ is Asn or Gln;

X comprises a glucuronyl class moiety prepared from 1-alkyl beta-D-glucosides, 1-alkyl beta-D-maltosides, 1-alkyl beta-D-melibiosides, or the corresponding alpha glycosides, and the like, and where alkyl is a $C_8$-$C_{20}$ linear alkyl chain.

In some embodiments of Formula I-A, III-A, or III-B, the peptide product has the structure:

(SEQ. ID. NO. 797)

$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-Glu*$_{16}$-$Gln_{17}$ $Ala_{18}$-$Ala_{19}$-Lys*$_{20}$-$Glu_{21}$-$Phe_{22}$-$Ile_{23}$-Lys(N-omega-X)$_{24}$-$Trp_{25}$-$Leu_{26}$-$Leu_{27}$-$Gln_{28}$-$Thr_{29}$-$NH_2$;

wherein $aa_{16}$ and $aa_{20}$ are cyclized through their side chains to form a lactam linkage;

and X comprises a glucuronyl class moiety prepared from 1-alkyl beta-D-glucosides, 1-alkyl beta-D-maltosides, 1-alkyl beta-D-melibiosides, or the corresponding alpha glycosides, and the like, and where alkyl is a $C_8$-$C_{20}$ linear alkyl chain.

In some embodiments of Formula I-A, III-A, or III-B, the peptide product has the structure:

(SEQ. ID. NO. 601)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$ Ala$_{18}$-Ala$_{19}$-Lys*$_{20}$-Glu$_{21}$-Phe$_{22}$-Ile$_{23}$-Lys(N-omega(1-dodecyl beta-D-glucuronyl))$_{24}$-Trp$_{25}$-Leu$_{26}$-Leu$_{27}$-Gln$_{28}$-Thr$_{29}$-NH$_2$;

wherein

Glu*$_{16}$ and Lys*$_{20}$ are cyclized through their side chains to form a lactam linkage.

In some embodiments of Formula I-A, III-A, or III-B, the peptide product has the structure:

(SEQ. ID. NO. 602)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$ Ala$_{18}$-Ala$_{19}$-Lys*$_{20}$-Glu$_{21}$-Phe$_{22}$-Ile$_{23}$-Lys(N-omega(1-tetradecyl beta-D-glucuronyl))$_{24}$-Trp$_{25}$-Leu$_{26}$-Leu$_{27}$-Gln$_{28}$-Thr$_{29}$-NH$_2$;

wherein

Glu*$_{16}$ and Lys*$_{20}$ are cyclized through their side chains to form a lactam linkage.

In some embodiments of Formula I-A, III-A, or III-B, the peptide product has the structure:

(SEQ. ID. NO. 603)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$ Ala$_{18}$-Ala$_{19}$-Lys*$_{20}$-Glu$_{21}$-Phe$_{22}$-Ile$_{23}$-Lys(N-omega(1-hexadecyl beta-D-glucuronyl))$_{24}$-Trp$_{25}$-Leu$_{26}$-Leu$_{27}$-Gln$_{28}$-Thr$_{29}$-NH$_2$;

wherein

Glu*$_{16}$ and Lys*$_{20}$ are cyclized through their side chains to form a lactam linkage.

In some embodiments of Formula I-A, III-A, or III-B, the peptide product has the structure:

(SEQ. ID. NO. 604)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$ Ala$_{18}$-Ala$_{19}$-Lys*$_{20}$-Glu$_{21}$-Phe$_{22}$-Ile$_{23}$-Lys(N-omega(1-octadecyl beta-D-glucuronyl))$_{24}$-Trp$_{25}$-Leu$_{26}$-Leu$_{27}$-Gln$_{28}$-Thr$_{29}$-NH$_2$; .

wherein

Glu*$_{16}$ and Lys*$_{20}$ are cyclized through their side chains to form a lactam linkage.

In some embodiments of Formula I-A, III-A, or III-B, aa$_{16}$ and aa$_{20}$ are cyclized to form a lactam linkage.

In some embodiments, for any compound of Formula I-A, III-A, or III-B, X is comprised of a dodecyl, tetradecyl, hexadecyl, or octadecyl alkyl chain.

In some embodiments, the peptide product is a biologically active peptide product that binds to the GLP1R and/or to the GLCR.

In a specific embodiment, the peptide products of Formula I-A, III-A, or III-B, described above and herein have the following structure:

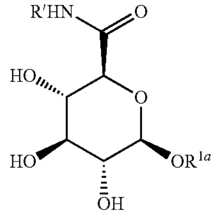

wherein $R^{1a}$ is a $C_1$-$C_{20}$ alkyl chain as described in Table 1 of FIG. 1, R' is a peptide as described in Table 1 of FIG. 1, Table 2 of FIG. 2, and Table 3 of FIG. 3, $W^2$ of Formula I-A is —O—, and $W^1$ of Formula I-A is —(C═O)NH— and is part of an amide linkage to the peptide R'. In some of such embodiments, $R^{1a}$ is a $C_6$-$C_{20}$ alkyl chain. In some of such embodiments, $R^{1a}$ is a $C_8$-$C_{20}$ alkyl chain. In some of such embodiments, $R^{1a}$ is a $C_{12}$-$C_{20}$ alkyl chain. In some of such embodiments, $R^{1a}$ is a $C_{12}$-$C_{16}$ alkyl chain.

In embodiments described above, an amino moiety of an amino acid and/or a peptide R' (e.g., an amino group of an amino acid residue such as a Lysine, or a lysine residue within the peptide R') is used to form a covalent linkage with a compound of structure:

(Formula A)

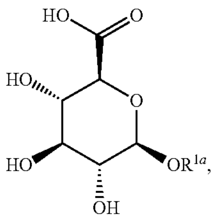

wherein $R^{1a}$ is a $C_1$-$C_{20}$ alkyl chain as described above and in Table 1 of FIG. 1, Table 2 of FIG. 2, and Table 3 of FIG. 3.

In such cases, the amino acid residue having an amino moiety (e.g., a Lysine within the peptide R') which is used to form a covalent linkage to the compound A described above, is a linker amino acid U which is attached to a surfactant X having the structure of Formula A. Accordingly, as one example, Lys(C12) of Table 1 of FIG. 1, Table 2 of FIG. 2, or Table 3 of FIG. 3 has the following structure:

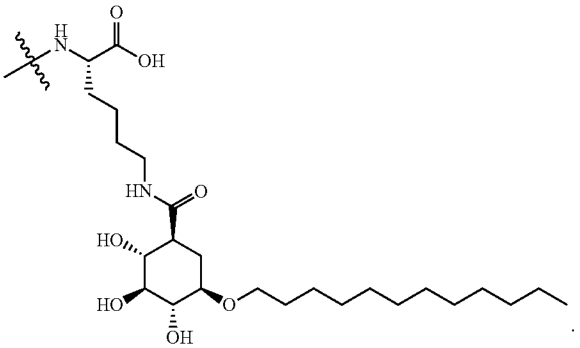 [SMILES: *N[C@@H](CCCCNC(=O)[C@H]1C[C@@H](OCCCCCCCCCCCC)[C@H](O)[C@@H](O)[C@@H]1O)C(=O)O]

Also contemplated within the scope of the embodiments presented herein are peptide products of Formula I-A derived from maltouronic acid-based surfactants through binding at either or both carboxylic acid functions. Thus, as one example, peptides in Table 1 of FIG. 1, Table 2 of FIG. 2, or Table 3 of FIG. 3 comprise a lysine linker amino acid bonded to a maltouronic acid based surfactant X and having a structure:

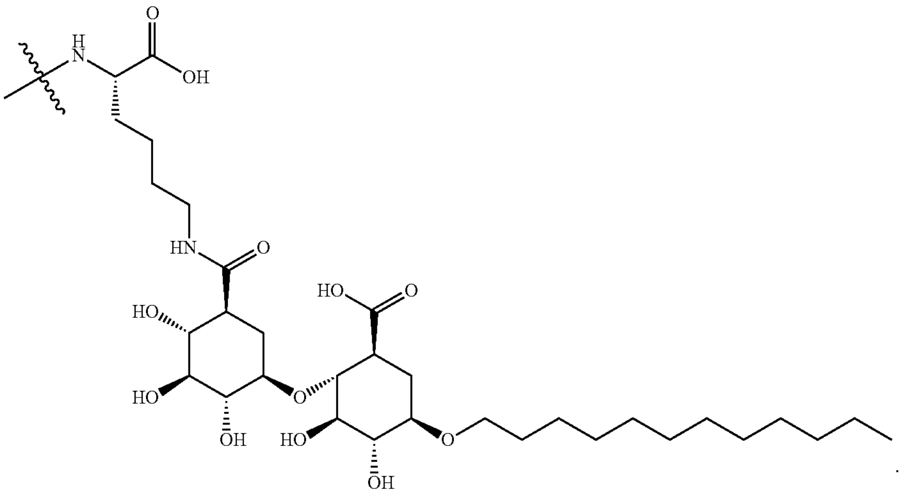 [SMILES: *N[C@@H](CCCCNC(=O)[C@H]1C[C@@H](O[C@H]2[C@H](O)[C@@H](O)[C@H](OCCCCCCCCCCCC)C[C@@H]2C(=O)O)[C@H](O)[C@@H](O)[C@@H]1O)C(=O)O]

It will be understood that in one embodiment, compounds of Formula I-A are prepared by attaching a lysine to a group X, followed by attachment of additional amino acid residues and/or peptides are attached to the lysine-X compound to obtain compounds of Formula I-A. It will be understood that other natural or non-natural amino acids described herein are also suitable for attachment to the surfactant X and are suitable for attaching additional amino acid/peptides to obtain compounds of Formula I-A. It will be understood that in another embodiment, compounds of Formula I-A are prepared by attaching a full length or partial length peptide to a group X, followed by optional attachment of additional amino acid residues and/or peptides are attached to obtain compounds of Formula I-A.

In a specific embodiment, provided herein is a compound selected from compounds of Table 1 of FIG. 1, Table 2 of FIG. 2, or Table 3 of FIG. 3.

Also provided herein are pharmaceutical compositions comprising a therapeutically effective amount of a peptide product described above, or acceptable salt thereof, and at least one pharmaceutically acceptable carrier or excipient.

In some embodiments of the pharmaceutical compositions, the carrier is an aqueous-based carrier. In some embodiments of the pharmaceutical compositions, the carrier is a nonaqueous-based carrier. In some embodiments of the pharmaceutical compositions, the nonaqueous-based carrier is a hydrofluoroalkane-like solvent that may comprise sub-micron anhydrous α-lactose or other excipients.

Contemplated within the scope of embodiments presented herein is the reaction of an amino acid and/or a peptide comprising a linker amino acid U bearing a nucleophile, and a group X comprising a bearing a leaving group or a functional group that can be activated to contain a leaving group, for example a carboxylic acid, or any other reacting group, thereby allowing for covalent linkage of the amino acid and/or peptide to a surfactant X via the linker amino acid U to provide a peptide product of Formula I-A.

Also contemplated within the scope of embodiments presented herein is the reaction of an amino acid and/or a peptide comprising a linker amino acid U bearing a bearing a leaving group or a functional group that can be activated to contain a leaving group, for example a carboxylic acid, or any other reacting group, and a group X comprising a nucleophilic group, thereby allowing for covalent linkage of the amino acid and/or peptide to a surfactant X via the linker amino acid U to provide a peptide product of Formula I-A.

It will be understood that, in one embodiment, Compounds of Formula I-A are prepared by reaction of a linker amino acid U with X, followed by addition of further residues to U to obtain the peptide product of Formula I-A. It will be understood that in an alternative embodiment, Compounds of Formula I-A are prepared by reaction of a suitable peptide comprising a linker amino acid U with X, followed by optional addition of further residues to U, to obtain the peptide product of Formula I-A.

Further provided herein are methods for synthesizing peptide products described above, comprising sequential steps of (a) Coupling a peptide with an intermediate, i.e., a compound of Formula IV:

Formula IV

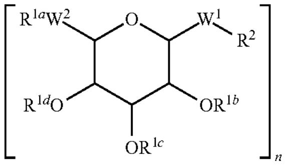

wherein:

$R^{1a}$ is independently, at each occurrence, a bond, H, a saccharide, a leaving group, a protecting group, a natural or unnatural amino acid, a substituted or unsubstituted $C_1$-$C_{30}$ alkyl group, a substituted or unsubstituted alkoxyaryl group, or a substituted or unsubstituted aralkyl group;

$R^{1b}$, $R^{1c}$, and $R^{1d}$ are each independently, at each occurrence, a bond, H, a leaving group, a protecting group, a reversibly protected natural or unnatural amino acid, a substituted or unsubstituted $C_1$-$C_{30}$ alkyl group, a substituted or unsubstituted alkoxyaryl group, or a substituted or unsubstituted aralkyl group;

$W^1$ is —$CH_2$—, —$CH_2$—O—, —(C═O), —(C═O)—O—, —(C═O)—NH—, —(C═S)—, —(C═S)—NH—, or —$CH_2$—S—;

$W^2$ is —O—, —$CH_2$— or —S—;

$R^2$ is independently, at each occurrence, a bond, H, a leaving group, a protecting group, a reversibly protected natural or unnatural amino acid, a substituted or unsubstituted $C_1$-$C_{30}$ alkyl group, a substituted or unsubstituted alkoxyaryl group, or a substituted or unsubstituted aralkyl group, —$NH_2$, —SH, $C_2$-$C_4$-alkene, $C_2$-$C_4$-alkyne, —NH(C═O)—$CH_2$—Br, —$(CH_2)_m$-maleimide, or —$N_3$;

n is 1, 2 or 3;

m is integer of 1-10;

and (b) optionally deprotecting the coupled peptide of step (a).

In some embodiments of the methods, each natural or unnatural amino acid is independently, at each occurrence, a reversibly protected linker amino acid. In some embodiments of the methods, each natural or unnatural amino acid is independently, at each occurrence, a reversibly protected or free lysine.

In some embodiments of the methods, the peptide is a peptide of Formula II as described above.

In some embodiments of the methods, n is 1;

$W^1$ is —(C═O)—;

$R^{1a}$ is a substituted or unsubstituted $C_1$-$C_{30}$ alkyl group, a substituted or unsubstituted 1-alkoxyaryl group, or a substituted or unsubstituted 1-aralkyl group, $R^2$ is a reversibly-protected lysine of D- or L-configuration.

In some embodiments of the methods, n is 1;

$W^1$ is —(C═O)—;

$R^{1a}$ is a substituted or unsubstituted $C_8$-$C_{30}$ alkyl group, a substituted or unsubstituted 1-alkoxyaryl group, or a substituted or unsubstituted 1-aralkyl group, $R^2$ is a reversibly protected lysine of D- or L-configuration.

In some embodiments of the methods, $R^{1a}$ is an octyl, decyl, dodecyl, tetradecyl, or hexadecyl group.

In some embodiments described above and herein, $R^{1a}$ is a saccharide. In some embodiments, the saccharide is a galactose. In certain embodiments, the saccharide is an alpha-linked galactose. In other embodiments, the saccharide is alpha-linked galactopyranose, beta-linked galactopyranose, alpha-linked galactofuranose, or beta-linked galactofuranose.

In some embodiments of the methods, n is 1;

$W^1$ is —(C═O)—NH— or —(C═O)—O—;

$R^2$ is a substituted or unsubstituted $C_1$-$C_{30}$ alkyl hydrophobic group, a substituted or unsubstituted 1-alkoxyaryl group, or a substituted or unsubstituted 1-aralkyl group, $R^{1a}$ is a reversibly protected serine or threonine of D- or L-configuration.

In some embodiments of the methods, $R^2$ is an octyl, decyl, dodecyl, tetradecyl or hexadecyl group.

In some embodiments of the methods, n is 1;

m is 1-6;

$W^1$ is —$CH_2$—;

$R^{1a}$ is a substituted or unsubstituted $C_1$-$C_{30}$ alkyl hydrophobic group, a substituted or unsubstituted 1-alkoxyaryl group, or a substituted or unsubstituted 1-aralkyl group, $R^2$ is —$N_3$, $NH_2$, —$C_2$-alkyne, —$(CH_2)_m$-maleimide, NH—(C═O)—$CH_2$—Br, or

NH—(C═O)—$CH_2$—I.

In some embodiments of Formula IV, n is 1;

$W^1$ is —(C═O)—O—;

$R^2$ is H, $R^{1a}$ is a substituted or unsubstituted $C_1$-$C_{30}$ alkyl hydrophobic group.

In some embodiments of the methods, $W^1$ is —$(CH_2)$O. In some embodiments of the methods, n is 1. In some embodiments of the methods, n is 2, and a first glycoside is attached to a second glycoside via bond between $W^2$ of the first glycoside and any one of $OR^{1b}$, $OR^{1c}$ or $OR^{1d}$ of the second glycoside.

In some embodiments of the methods, n is 3, and a first glycoside is attached to a second glycoside via bond between $W^2$ of the first glycoside and any one of $OR^{1b}$, $OR^{1c}$ or $OR^{1d}$ of the second glycoside, and the second glycoside is attached to a third glycoside via bond between $W^2$ of the second glycoside and any one of $OR^{1b}$, $OR^{1c}$ or $OR^{1d}$ of the third glycoside.

In some embodiments of the methods, the compound of Formula IV is a reversibly protected N-ε-(1'-alkyl glucuronyl)-lysine of the D- or L-configuration, wherein $R^{1a}$ is a substituted or unsubstituted $C_1$-$C_{20}$ alkyl chain, a substituted or unsubstituted 1-alkoxyaryl group, or a substituted or unsubstituted 1-aralkyl group.

In some embodiments of the methods, the compound of Formula IV is a reversibly protected N-ε-(1'-dodecyl β-D-glucuronyl)-lysine of the D- or L-configuration.

In some embodiments of the methods, the deprotecting comprises the use of mild acid and or mild base treatments. In some embodiments of the methods, the deprotecting comprises the use of strong acids.

In some embodiments, the methods further comprise the steps of chromatography, desalting of intermediates by reversed-phase, high-performance liquid chromatography or ion exchange chromatography of intermediates.

A pharmaceutical composition comprising a therapeutically effective amount of a peptide product described above and herein, or acceptable salt thereof, and at least one pharmaceutically acceptable carrier or excipient.

Provided herein is a method for treating a condition associated with insulin resistance comprising administration of any peptide product or compound described herein to an individual in need thereof.

Provided herein are methods for treating diabetes, diabetic retinopathy, diabetic neuropathy, diabetic nephropathy, wound healing, insulin resistance, hyperglycemia, hyperinsulinemia, metabolic syndrome, diabetic complications, elevated blood levels of free fatty acids or glycerol, hyperlipidemia, obesity, hypertriglyceridemia, atherosclerosis, acute cardiovascular syndrome, infarction, ischemic reperfusion or hypertension, comprising administering a therapeutically effective amount of a peptide product described above and herein to an individual in need thereof.

Provided herein are methods of reducing weight gain or inducing weight loss comprising administering to a subject in need thereof a therapeutically effective amount of a peptide product described above and herein to an individual in need thereof.

Provided herein are methods for treating mammalian conditions characterized by obesity-linked insulin resistance or the metabolic syndrome comprising administering to a subject in need thereof a weight loss-inducing or insulin-sensitizing amount of a peptide product described above and herein to an individual in need thereof.

In some embodiments, the condition to be treated is the metabolic syndrome (Syndrome X). In some embodiments, the condition to be treated is diabetes. In some embodiments, the condition to be treated is hyperlipidemia. In some embodiments, the condition to be treated is hypertension. In some embodiments, the condition to be treated is vascular disease including atherosclerosis, or the systemic inflammation characterized by elevated C reactive protein.

In some embodiments of the methods, the effective amount of the peptide product for administration is from about 0.1 μg/kg/day to about 100.0 μg/kg/day, or from 0.01 μg/kg/day to about 1 mg/kg/day or from 0.1 μg/kg/day to about 50 mg/kg/day. In some embodiments, the peptide product is administered parenterally. In some embodiments, the peptide product is administered subcutaneously. In some embodiments, the method of administration of the peptide product is nasal insufflation.

It will be understood, however, that the specific dose level and frequency of dosage for any particular subject in need of treatment may be varied and will depend upon a variety of factors including the activity of the specific compound employed, the metabolic stability and duration of action of that compound, the age, body weight, general health, sex, diet, mode and time of administration, rate of excretion, drug combination, the severity of the particular condition, and the host undergoing therapy.

Provided herein are methods of treating the metabolic syndrome, or its component diseases, comprising administering to a subject in need thereof a therapeutically effective amount of a peptide product described above. In some embodiments, the metabolic syndrome condition has progressed to diabetes.

Also provided herein is a covalently modified GLCR and/or GLP1R binding peptide or analog thereof, comprising a hydrophilic group as described herein; and a hydrophobic group covalently attached to the hydrophilic group. In specific embodiments, the covalently modified peptide and/or protein product comprises a hydrophilic group that is a saccharide and a hydrophobic group that is a $C_1$-$C_{20}$ alkyl chain or an aralkyl chain.

In one embodiment, provided is a method for chemically modifying a molecule by covalent linkage to a surfactant to increase or sustain the biological action of the composition or molecule, for example, receptor binding or enzymatic activity. In some embodiments, the molecule is a peptide. The method additionally can include further modification comprising covalent attachment of the molecule in the composition to a polymer such as polyethylene glycol.

In another embodiment, provided is a method of reducing or eliminating immunogenicity of a peptide and/or protein drug by covalently linking the peptide chain to at least one alkyl glycoside wherein the alkyl has from 1 to 30 carbon atoms.

Also provided is a method of treating conditions associated with insulin resistance including and not limited to obesity, the metabolic syndrome, type 2 diabetes, hypertension, atherosclerosis or the like, comprising administering a drug composition comprising a peptide covalently linked to at least one alkyl glycoside and delivered to a vertebrate, wherein the alkyl has from 1 to 30 carbon atoms, 1 to 20 carbons, or further in the range of 6 to 16 carbon atoms, or 6 to 18 carbons, and wherein covalent linkage of the alkyl glycoside to the peptide increases the stability, bioavailability and/or duration of action of the drug.

Further provided herein is the use of a peptide product described herein (e.g., a peptide product of Formula I-A, Formula III-A, or Formula III-B) for the manufacture of a medicament for treatment of any condition described above and herein.

BRIEF DESCRIPTION OF THE FIGURES

FIG. 1: Table 1 in FIG. 1 depicts compounds that were prepared by methods described herein. The specification provides sequences for SEQ. ID. Nos. 1-3 and SEQ. ID. Nos. 774-783 and 785-797. Additionally, Table 1 of FIG. 1 provides SEQ. ID Numbers for compounds EU-A300 to EU-A425 having SEQ. ID. NOs. 4-129 respectively, as shown in Table 1 of FIG. 1. Compounds in Table 1 of FIG. 1, and their respective SEQ. ID. NOs. shown in Table 1 of FIG. 1 are hereby incorporated into the specification as filed.

FIG. 2: Table 2 in FIG. 2 depicts compounds that were prepared by methods described herein. The specification provides SEQ. ID. Nos. 1-3 and SEQ. ID. Nos. 774-797. Additionally, Table 2 of FIG. 2 provides SEQ. ID Numbers for compounds EU-A426 to EU-599 having SEQ. ID. NOs. 130-317 respectively, as shown in Table 2 of FIG. 2. Compounds in Table 2 of FIG. 2, and their respective SEQ. ID. NOs. shown in Table 2 of FIG. 2 are hereby incorporated into the specification as filed.

FIG. 3: Table 3 in FIG. 3 depicts compounds that were prepared by methods described herein. The specification provides SEQ. ID. Nos. 1-3 and SEQ. ID. Nos. 774-797. Additionally, Table 3 of FIG. 3 provides SEQ. ID Numbers for compounds EU-A700 to EU-A1174 having SEQ. ID. NOs. 318-773; 798-806 respectively, as shown in Table 3 of FIG. 3. Compounds in Table 3 of FIG. 3, and their respective SEQ. ID. NOs. shown in Table 3 of FIG. 3 are hereby incorporated into the specification as filed.

FIG. 4 illustrates the x-ray crystal structure (Runge, S., et al. (2008) J Biol Chem 283: 11340-7) of the binding site of the extracellular domain of the GLP-1 receptor and illustrates critical hydrophobic binding elements of the receptor and the ligand exendin-4 ($Val^{19*}$, $Phe^{22*}$, $Trp^{25*}$, $Leu^{26*}$) which are mimicked and replaced by the hydrophobic 1'-alkyl portion of the surfactant on the peptides of the invention. In this case the asterisk means the residue is in the ligand.

FIG. 5 illustrates the in vivo blood glucose response in db/db mice upon s.c. administration of the listed amount of test compounds of the invention (EU-A993 and EU-A1023) at times t=0, 7 hrs.

FIG. 6 illustrates examples of the detailed structure of some compounds of the invention and their linkage through the epsilon amino function of a Lys residue, in this case at position 24 (of SEQ ID NOs: 600, 630 and 801), to examples of mono and disaccharide surfactants modified according to one method of the invention.

FIG. 7 illustrates the structure of EU-A992 (SEQ ID NO: 600), an example of the types of structures of the invention.

DETAILED DESCRIPTION OF THE INVENTION

Figure 4:
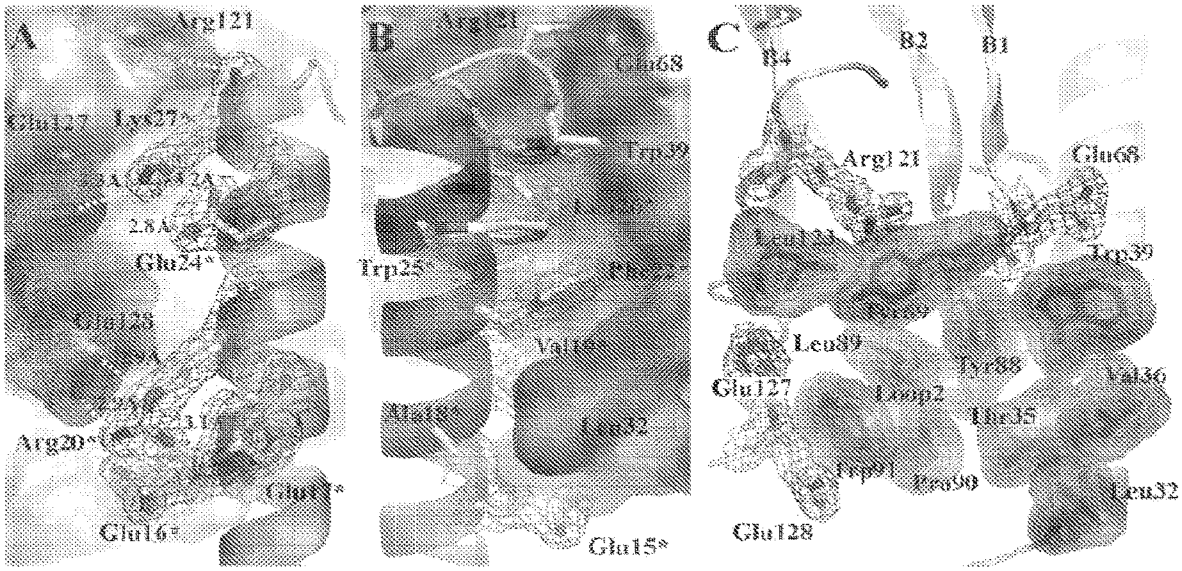
FIG. 4.

Described herein are certain covalently modified peptides and/or proteins with improved pharmaceutical properties. Also provided herein are methods for use of the covalently modified peptides and/or proteins for treatment of disorders related to obesity and the metabolic syndrome.

In some embodiments, the modified peptides and/or proteins comprise a peptide and/or protein covalently attached to a hydrophilic group, a "head" (e.g., a polyol, (e.g., a saccharide)); the hydrophilic group is covalently attached to a hydrophobic group, a "tail", thereby generating a surfactant. In some embodiments, use of hydrophobic-linked glycoside surfactant (e.g., alkyl glycoside) moieties for covalent modification of the peptides or proteins (e.g., glucagon or GLP-1 related peptides or the like), prolongs the duration of action of the peptides and/or proteins by multiple mechanisms, including formation of depots of the drug at the site of administration in the body and binding to hydrophobic carrier proteins. In some embodiments, incorporation of steric hindrance into peptide and/or protein structure can prevent approach of proteases to the peptide and/or protein product and thereby prevent proteolysis. In some embodiments, surfactant modification (e.g., covalent attachment of alkyl glycoside class of surfactants) of peptides and/or proteins as described herein, increases the transport across mucosal barriers. Accordingly, the modifications of the peptides and/or proteins described herein provide desirable benefits including and not limited to, protection from proteolysis, and slowed movement from the site of administration, thereby leading to prolonged pharmacokinetic behavior (e.g., prolongation of circulating $t_{1/2}$) and improved transmucosal bioavailability.

In some embodiments, interaction of the improved peptides and/or proteins with their receptors is modified in beneficial ways by the truncation of the sequence, introduction of constraint, and/or the incorporation of steric hindrance. Described herein are novel alkyl glycoside reagents that allow for incorporation of both rigidity and steric hindrance in the modified peptides and/or proteins. In some embodiments, steric hindrance confers receptor selectivity to the modified peptides and/or proteins described herein. In some embodiments, steric hindrance provides protection from proteolysis.

Proteins and peptides undergo numerous physical and chemical changes that may affect potency and safety. Among these are aggregation, which includes dimerization, trimerization, and the formation of higher-order aggregates such as amyloids. Aggregation is a key issue underlying multiple potentially deleterious effects for peptide and/or protein-based therapeutics, including loss of efficacy, altered pharmacokinetics, reduced stability or product shelf life, and induction of undesirable immunogenicity. Bioavailability and pharmacokinetics of a self-associating peptide can be influenced by aggregate size and the ease of disruption of the non-covalent intermolecular interactions at the subcutaneous site (Maji, S. K., et al. (2008) PLoS Biol 6: e17). In some instances, peptides can aggregate into subcutaneous depots that disassociate with $t_{1/2}$ of 30 or more days. Such slow dissolution can lead to favorable effects such as delivery for one month from a single sc injection causes such a low blood concentration that the peptide appears inactive in vivo. Thus, in some instances, hydrophobic aggregation precludes a peptide's bioavailability and effectiveness (Clodfelter, D. K., et al. (1998) Pharm Res 15: 254-262). The modified peptide products described herein are surfactant-linked and are optionally designed to allow for either interference with aggregation, or enhanced aggregation, as desired.

Often naturally occurring oligosaccharides that are covalently attached to proteins do not have surfactant character. In some embodiments, peptide and/or protein products described herein have a covalently attached saccharide and an additional hydrophobic group that confers surfactant character to the modified peptides, thereby allowing for tunability of bioavailability, immunogenicity, and/or pharmacokinetic behavior of the surfactant-modified peptides.

Proteins and peptides modified with oligosaccharides are described in, for example, Jensen, K. J. and Brask, J. (2005) Biopolymers 80: 747-761, through incorporation of saccharide or oligosaccharide structures using enzymatic (Gijsen, H. J., et al. (1996) Chem Rev 96: 443-474; Sears, P. and Wong, C. H. (1998) Cell Mol Life Sci 54: 223-252; Guo, Z. and Shao, N. (2005) Med Res Rev 25: 655-678) or chemical approaches (Urge, L., et al. (1992) Biochem Biophys Res Commun 184: 1125-1132; Salvador, L. A., et al. (1995) Tetrahedron 51: 5643-5656; Kihlberg, J., et al. (1997) Methods Enzymol 289: 221-245; Gregoriadis, G., et al. (2000) Cell Mol Life Sci 57: 1964-1969; Chakraborty, T. K., et al. (2005) Glycoconj J 22: 83-93; Liu, M., et al. (2005) Carbohydr Res 340: 2111-2122; Payne, R. J., et al. (2007) J Am Chem Soc 129: 13527-13536; Pedersen, S. L., et al. (2010) Chembiochem 11: 366-374). Peptides as well as proteins have been modified by glycosylation (Filira, F., et al. (2003) Org Biomol Chem 1: 3059-3063); (Negri, L., et al. (1999) J Med Chem 42: 400-404); (Negri, L., et al. (1998) Br J Pharmacol 124: 1516-1522); Rocchi, R., et al. (1987) Int J Pept Protein Res 29: 250-261; Filira, F., et al. (1990) Int J Biol Macromol 12: 41-49; Gobbo, M., et al. (1992) Int J Pept Protein Res 40: 54-61; Urge, L., et al. (1992) Biochem Biophys Res Commun 184: 1125-1132; Djedaini-Pilard, F., et al. (1993) Tetrahedron Lett 34: 2457-2460; Drouillat, B., et al. (1997) Bioorg Med Chem Lett 7: 2247-2250; Lohof, E., et al. (2000) Angew Chem Int Ed Engl 39: 2761-2764; Gruner, S. A., et al. (2001) Org Lett 3: 3723-3725; Pean, C., et al. (2001) Biochim Biophys Acta 1541: 150-160; Filira, F., et al. (2003) Org Biomol Chem 1: 3059-3063; Grotenbreg, G. M., et al. (2004) J Org Chem 69: 7851-7859; Biondi, L., et al. (2007) J Pept Sci 13: 179-189; Koda, Y., et al. (2008) Bioorg Med Chem 16: 6286-6296; Yamamoto, T., et al. (2009) J Med Chem 52: 5164-5175).

However, the aforementioned attempts do not describe an additional hydrophobic group attached to the peptide-linked oligosaccharide. Accordingly, provided herein are modified peptides and/or proteins that incorporate a hydrophobic group attached to a saccharide and/or oligosaccharide that is covalently attached to the peptide and/or protein and that allow for tunability of bioavailability, immunogenicity and pharmacokinetic behavior. Accordingly, also provided herein are surfactant reagents comprising an oligosaccharide and a hydrophobic group, that allow for covalent modification of peptides and/or proteins such as, for example, glucagon and/or GLP-1 and/or analogs thereof.

Provided herein is the use of saccharide-based surfactants in covalent linkage to a peptide for improvement of peptide and/or protein properties. In some embodiments, surfactant modification (e.g., covalent attachment of alkyl glycoside class of surfactants) of peptides and/or proteins as described herein, increases the transport across mucosal barriers. In some embodiments, covalent attachment of a surfactant to a peptide and/or protein product reduces or prevents aggregation of the peptide and/or protein. In some embodiments, the covalently modified peptides and/or proteins are covalently modified glucagon or GLP-1 peptides, or analogs thereof, which are modified to improve their pharmaceutical and medical properties by covalent modification with alkyl glycoside surfactant moieties. These surfactant-modified analogs have increased steric hindrance that hinder proteolysis, slows uptake and slows clearance from the body.

In certain instances, the effects of surfactants are beneficial with respect to the physical properties or performance of pharmaceutical formulations, but are irritating to the skin and/or other tissues and in particular are irritating to mucosal membranes such as those found in the nose, mouth, eye, vagina, rectum, buccal or sublingual areas. Additionally, in some instances, surfactants denature proteins thus destroying their biological function. Since surfactants exert their effects above the critical micelle concentration (CMC), surfactants with low CMC's are desirable so that they may be utilized with effectiveness at low concentrations or in small amounts in pharmaceutical formulations. Accordingly, in some embodiments, surfactants (e.g., alkyl glycosides) suitable for peptide modifications described herein have the CMC's less than about 1 mM in pure water or in aqueous solutions. By way of example only, certain CMC values for alkyl glycosides in water are: Octyl maltoside 19.5 mM; Decyl maltoside 1.8 mM; Dodecyl-β-D-maltoside 0.17 mM; Tridecyl maltoside 0.03 mM; Tetradecyl maltoside 0.01 mM; Sucrose dodecanoate 0.3 mM. It will be appreciated that a suitable surfactant could have a higher or lower CMC depending on the peptide and/or protein that is modified. As used herein, "Critical Micelle Concentration" or "CMC" is the concentration of an amphiphilic component (alkyl glycoside) in solution at which the formation of micelles (spherical micelles, round rods, lamellar structures etc.) in the solution is initiated. In certain embodiments, the alkyl glycosides dodecyl, tridecyl and tetradecyl maltoside or glucoside as well as sucrose dodecanoate, tridecanoate, and tetradecanoate are possess lower CMC's and are suitable for peptide and/or protein modifications described herein.

Insulin Resistance

The risks associated with prolonged hyperglycemia include an increased risk of microvascular complications, sensory neuropathy, myocardial infarction, stroke, macrovascular mortality, and all-cause mortality. Type 2 diabetes is also linked causally with obesity, an additional global epidemic. At least $232 billion were spent on treatment and prevention of diabetes worldwide in 2007, with three quarters of that amount spent in industrialized countries on the treatment of long-term complications and on general care, such as efforts to prevent micro and macrovascular complications. In 2007, estimated indirect costs of diabetes (disability, lost productivity, and premature death due to diabetes) to the United States economy were $58 billion.

Obesity leads to insulin resistance, a decreased ability of the cells in the body to react to insulin stimulation through decreased numbers of insulin receptors and a decreased coupling of those receptors to critical intracellular signaling systems. The obese state further leads to the "metabolic syndrome", a constellation of diseases (insulin resistance, hypertension, atherosclerosis, etc.) with very large healthcare consequences. If insulin resistance is diagnosed early enough, overt type 2 diabetes can be prevented or delayed, with lifestyle interventions aimed at reducing calorie intake and body fat and through drug treatment to normalize glycemic control. Despite treatment guidelines recommending early, aggressive intervention, many patients fail to reach targets for glycemic control. Many factors contribute to the failure to manage type 2 diabetes successfully including psychosocial and economic influences and shortcomings in the efficacy, convenience and tolerability profiles of available antidiabetic drugs. The peptide and/or protein products described herein are designed to overcome these shortcomings.

Incretin Effect

The "incretin effect" is used to describe the phenomenon whereby a glucose load delivered orally produces a much greater insulin secretion than the same glucose load administered intravenously. This effect is mediated by at least two incretin hormones secreted by intestinal L-cells. Glucose-dependent insulinotropic polypeptide (GIP) and glucagon-like peptide 1 (GLP-1) were identified as incretins and it is thought that healthy individuals may derive up to 70% of their prandial insulin secretory response from the incretin effect.

Normally the incretin peptides are secreted as needed, in response to ingested nutrients, and have a short plasma half-life due to degradation by dipeptidyl peptidase IV (DPP-4) enzyme. In people with type 2 diabetes, pancreatic responsiveness to GLP-1 is impaired, but the insulin-secretory response can be restored with pharmacologic doses of human GLP-1 (Kieffer, T. J., et al. (1995) Endocrinology 136: 3585-3596). In addition, GLP-1 promotes beta-cell neogenesis and preservation (Aaboe, K., et al. (2008) Diabetes Obes Metab 10: 994-1003). GLP-1 has additional beneficial effects such as on cardiac function (Treiman, M., et al. (2010) Trends Cardiovasc Med 20: 8-12): for example it improves left ventricular function (Sokos, G. G., et al. (2006) J Card Fail 12: 694-699) in human subjects. GLP-1 also slows gastric emptying in humans and reduces appetite (Toft-Nielsen, M. B., et al. (1999) Diabetes Care 22: 1137-1143).

Treatment of diabetes patients with metabolically stable and long-acting analogs of GLP-1 is described in, for example, Drab, S. R. (2010) Pharmacotherapy 30: 609-624, suffers from issues related to convenience of use and side effects such as nausea, risk of pancreatitis and thyroid carcinoma. GLP-1 analogs provide glucose-dependent stimulation of insulin secretion and lead to a reduced risk of hypoglycemia. In addition, while a number of the current treatments for diabetes cause weight gain, as described below, GLP-1 analogs induce satiety and a mild weight loss. Accordingly, in some embodiments, provided herein are GLP-1 analogs that are long acting and are administered at low doses thereby reducing side-effects associated with current treatments.

A number of peptide gut hormones are known to modulate appetite (Sanger, G. J. and Lee, K. (2008) Nat Rev Drug Discov 7: 241-254). Several peptides are derived from tissue-specific, enzymatic processing (prohormone convertases; PCs) of the preproglucagon gene product: e.g. glucagon, GLP-1, glucagon-like peptide-2 (GLP-2), glicentin and oxyntomodulin (OXM) (Drucker, D. J. (2005) Nat Clin Pract Endocrinol Metab 1: 22-31; Sinclair, E. M. and Drucker, D. J. (2005) Physiology (Bethesda) 20: 357-365). GLP-1, GLP-2, glicentin and OXM are co-secreted from L-cells in the gut in response to feeding. Preproglucagon is alternatively processed (PC2) to produce glucagon in the alpha cells in the pancreatic islets. The structure of OXM is essentially glucagon with a C-terminal extension of 8 residues.

In addition to the stimulation of insulin biosynthesis and of glucose-dependent insulin secretion, GLP-1 and its stable mimetics (e.g. exendin-4, liraglutide) also cause modest weight loss in animal models (Mack, C. M., et al. (2006) Int J Obes (Lond) 30: 1332-1340; Knudsen, L. B. (2010) Int J Clin Pract 64 (Suppl. 167): 4-11) and in Type 2 diabetic patients (DeFronzo, R. A., et al. (2005) Diabetes Care 28: 1092-1100; Buse, J. B., et al. (2010) Diabetes Care 33: 1255-1261). Glucagon infusion reduces food intake in man (Geary, N., et al. (1992) Am J Physiol 262: R975-980), while continuous glucagon treatment of adipose tissue also promotes lipolysis (Heckemeyer, C. M., et al. (1983) Endocrinology 113: 270-276) and weight loss (Salter, J. M., et al. (1960) Metabolism 9: 753-768; Chan, E. K., et al. (1984) Exp Mol Pathol 40: 320-327). Glucagon has wide-ranging effects on energy metabolism (Heppner, K. M., et al. (2010) Physiol Behav). Glucagon, or analogs, can be used in a diagnostic mode for temporary paralysis of the intestinal tract. Thus at least two of the products from PC processing of the preproglucagon protein are linked to satiety and metabolic effects.

In rodents, repeated intraperitoneal administration of OXM, a third product of preproglucagon, has been associated with reduced white adipose tissue and a reduction in weight compared with controls (Dakin, C. L., et al. (2004) Endocrinology 145: 2687-2695). Oxm reduced food intake by 19.3% during an intravenous infusion administration to normal-weight humans and this effect continues for more than 12 hr. after infusion (Cohen, M. A., et al. (2003) J Clin Endocrinol Metab 88: 4696-4701). Treatment of volunteers over a 4 week period resulted in a sustained satiety effect and weight loss reflecting a decrease in body fat (Wynne, K., et al. (2005) Diabetes 54: 2390-2395).

OXM is structurally homologous with GLP-1 and glucagon, and activates both the glucagon receptor (GCGR) and the GLP-1 receptor (GLP1R), but with 10 to 100 fold less potency than the eponymous ligands. In addition, study of OXM interactions with GLP1R suggest it might have different effects on beta-arrestin recruitment compared to GLP-1 (Jorgensen, R., et al. (2007) J Pharmacol Exp Ther 322: 148-154), thus acting as a "biased" ligand. A unique receptor for OXM was sought for a number of years, but has not yet been elucidated and it is assumed to act through the GLP1R and GCGR pathways. Accordingly, provided herein are methods for surfactant modification of gut peptides that allow for induction of satiety, weight loss, alleviation of insulin resistance and/or delay in progression of pre-diabetes to diabetes.

GLP-1

In view of the complex and interacting behavior of the products of the preproglucagon protein on satiety and metabolism described above, workers from multiple groups have studied the structure activity relationships on GLP-1 and glucagon structure. Residues throughout the sequences were shown to accept replacement. For example, replacement by Ala is well accepted in the N-terminal region of GLP-1, especially at 2, 3, 5, 8, 11, and 12 (Adelhorst, K., et al. (1994) J Biol Chem 269: 6275-6278).

It was shown that chimeric analogs with the ability to bind to GLP1R and GLCR could be achieved by grafting C-terminal residues from GLP-1 onto the N-terminus of glucagon (Hjorth, S. A., et al. (1994) J Biol Chem 269: 30121-30124). The residue at position 3 (acidic Glu in GLP1 or neutral Gln in Glucagon or OXM) reduces the affinity of glucagon (Runge, S., et al. (2003) J Biol Chem 278: 28005-28010) or OXM (Pocai, A., et al. (2009) Diabetes 58: 2258-2266) for the GlP1R. The effect on metabolic profile of animals treated with stabilized analogs of GLP-1 or glucagon or OXM with Gln in position 3 was studied (Day, J. W., et al. (2009) Nat Chem Biol 5: 749-757; Druce, M. R., et al. (2009) Endocrinology 150: 1712-1722; Pocai, A., et al. (2009) Diabetes 58: 2258-2266). These analogs were designed to have agonistic action on both GLP1R and on GCGR (Day, J. W., et al. US 2010/0190701 A1; Patterson, J. T., et al. (2011) J Pept Sci 17: 659-666; Ribier, D., US Patent Application 2012/0178670).

Chimeric analogs should have the desirable effects of the parent hormones acting on their receptors, and therefore similar to the effects of OXM, which apparently acts on both GLP-1R and GLCR: glucose-dependent insulin secretion and satiety, coupled with lipolysis and increased burning of fat due to glucagon. The analogs were shown to cause the desired effects of decreased weight and increased burning of fat. Such a profile would be attractive in the treatment of obesity, but a major challenge in obesity treatment is compliance. Although currently known full length analogs of glucagon and OXM, respectively, with affinity for both GLP-1R and GLCR can result in weight loss, these analogs are not optimized for the high bioavailability, pharmaceutical properties, and convenient delivery to patients that are necessary for optimal drug treatment regimens. Accordingly, provided herein are analogs of gut peptides (e.g., GLP, OXM, glucagon or the like) that allow for high bioavailability and/or long lasting effects for improved therapeutic outcome in treatment of conditions such as obesity and/or diabetes and/or the metabolic syndrome.

Additional factors for optimized treatment of the metabolic syndrome and diabetes with OXM-like molecules relate to the duration of treatment and the amount of glucagon action. For example, continuous treatment with analogs that activate GLP-1 and glucagon receptors (the OXM pharmacological profile) can result in very large and rapid loss of fat mass (Day, J. W., et al. (2009) Nat Chem Biol 5: 749-757), but it can also cause the loss of lean muscle mass (Kosinski, J. R., et al. (2012) Obesity (Silver Spring): doi: 10.1038/oby.2012.67), which is unfavorable for a pharmaceutical in this class. For example, in the research article by Kosinski, J. R., et al., the natural hormone Oxm is administered continuously for 14 days from an Alzet minipump and results in a decrease of 30% in fat mass, but also caused a 7% decrease in lean mass (muscle).

Glucagon action is known to stimulate glycogenolysis, lipolysis and the increased burning of fat, but can also have catabolic effects on muscle. A successful treatment using an agent that combines GLP-1 and glucagon action (the OXM profile) will need to optimally cause the satiety and potentiated glucose-dependent insulin secretion of a GLP-1 analog with a judicious amount of glucagon action (fat burning). In addition, intermittent use of such an agent will provide the desired clinical profile of moderate, continuous weight loss, through loss of fat mass, with minimized loss of lean mass. Provided herein are molecules with a desirable combination of GLP-1 and OXM action as well as a tunable pharmacokinetic/pharmacodynamic profile to allow optimum use in therapy (for example in the metabolic syndrome, diabetes, obesity, and the like).

In one embodiment, the compounds of Formula I-A, III-A, and III-B are designed to provide either glucagon-like activity or GLP-1 like activity. In a further embodiment, the compounds of Formula I-A, III-A, and III-B provide tunable activity. For example, in one instance, the peptide products described herein (e.g., compounds in Table 1 of FIG. 1, Table 2 of FIG. 2, and Table 3 of FIG. 3) have an EC50 of less than about 500 nM, preferably less than about 50 nM, more preferably less than about 20 nM at receptors for both glucagon, and GLP-1. In another instance, the peptide products described herein (e.g., compounds in Table 1 of FIG. 1, Table 2 of FIG. 2, and Table 3 of FIG. 3) are more potent (e.g., EC50 of less than 10 nM, preferably less than 5 nM, more preferably about 1 nM) for the GLP-1 receptor and less potent for the glucagon receptor (e.g., EC50 of less than 50 nM, preferably less than about 20 nM, more preferably about 5 nM) for the glucagon receptor. This tunability of biological activity allows for some retention of a judicious amount of glucagon action, thereby allowing for fat burning to occur, while also retaining the beneficial effects of potentiated glucose-dependent insulin secretion. OXM is structurally homologous with GLP-1 and glucagon, and activates both the glucagon receptor (GCGR) and the GLP-1 receptor (GLP1R). Accordingly, in some embodiments, the compounds of Formula I-A, Formula III-A, and Formula III-B provide a tunable OXM-like biological activity. In some specific embodiments, the peptide products described herein comprise a peptide having amino acid residues 1-17 of GLP-1 and/or analogs thereof (e.g., analogs comprising modified non-natural amino acid replacements as described herein, cyclized lactam linkages as described herein, surfactant modifications as described herein, or a combination thereof). In some other embodiments, the peptide products described herein comprise a peptide having amino acid residues 1-16 of GLP-1 and/or analogs thereof (e.g., analogs comprising modified non-natural amino acid replacements as described herein, cyclized lactam linkages as described herein, surfactant modifications as described herein, or a combination thereof). In additional embodiments, the peptide products described herein comprise a peptide having amino acid residues 1-18 of GLP-1 and/or analogs thereof (e.g., analogs comprising modified non-natural amino acid replacements as described herein, cyclized lactam linkages as described herein, surfactant modifications as described herein, or a combination thereof). Additionally the peptide products described herein comprise one or more residues (e.g., Aib, Ac4c) which provide helix stabilization of the designed compounds of Formula I-A, Formula III-A, and Formula III-B, and compounds in Table 1 of FIG. 1, Table 2 of FIG. 2, and Table 3 of FIG. 3.

It is believed that the glucagon subfamily of ligands bind to their receptors in a two domain mode common to a number of the class B of receptors (secretin class, G Protein-coupled Receptors (GPCR)). For GLP-1 it is felt that there is a N-terminal region of from residue 1 to about residue 16 which binds to the tops of the transmembrane helicies (juxtomembrane region) and a helical C-terminal region from 17 to 31 which binds to the large, extracellular, N-terminal extension (ECD) of the receptor. The binding of these ligands focuses on the fact that N-terminally truncated analogs of these peptide ligands can still retain substantial binding affinity and selectivity for just the isolated ECD region of the receptor. Therefore it has been suggested that the N-terminal region is responsible for receptor activation while the C-terminal region is responsible for binding. It recently has been shown that short, N-terminal analogs of GLP-1 can be both potent binders as well as receptor activators (Mapelli, C., et al. (2009) J Med Chem 52: 7788-7799; Haque, T. S., et al. (2010) Peptides 31: 950-955; Haque, T. S., et al. (2010) Peptides 31: 1353-1360).

In addition, study of an x-ray crystal structure (Runge, S., et al. (2008) J Biol Chem 283: 11340-7) of the N-terminal region of the GLP1R with a truncated antagonist analogs of the GLP-1 mimic, exendin-4 (Byetta), bound in this region show that a critical ligand-binding region in the ECD is of high hydrophobicity (FIG. 3). The sequence of exendin-4 beyond Glu15 interacts as an amphiphilic helix with this very hydrophobic region ($Val^{19*}$, $Phe^{22*}$, $Trp^{25*}$, $Leu^{26*}$), wherein in this case the asterisk denotes that it is a residue in the ligand. In one embodiment, truncated N-terminal fragments of GLP-1 or glucagon are modified to bind to GLCR and are covalently linked to a surfactant. The hydrophobic 1'-alkyl portion of the surfactant mimics and replaces the C-terminal region of the native hormone ligand and increases the peptides potency, efficacy, and duration of action. In addition, such analogs have major advantages due to their smaller size, which reduces their complexity, synthesis costs, and susceptibility to proteolysis. In addition smaller peptides are more readily absorbed through the nasal mucosa or gut enterocyte barrier.

Hypoglycemia is a condition of low blood sugar that can be life-threatening and is increasingly seen as more aggressive treatment of elevated blood sugar by intensive insulin treatment is being used in more patients. Hypoglycemia is seen when blood glucose levels drop too low to provide enough energy to the brain and muscles for the body's activities. Glucagon can be used to treat this condition and does so by stimulating the liver to break down glycogen to generate glucose and cause the blood glucose levels to rise toward the normal value. Analogs of glucagon that retain the ability to activate the GLCR may be used to achieve this desirable effect on blood glucose levels.

Analogs of GLP-1 that activate the GLP1R stimulate the production and, in the presence of elevated blood glucose levels, release of insulin from the pancreas. This action results in efficient control and normalization of blood glucose levels, as seen with current products such as exenatide (Byetta®). In addition, such products appear to produce a decreased appetite and slow the movement of food from the stomach. Thus they are effective in treatment of diabetes through multiple mechanisms. Analogs that combine the effects of glucagon and GLP-1 that activate both the GLCR and the GLP1R may offer a benefit in the treatment of diabetes through a concerted action to suppress appetite, release insulin in a glucose-dependent fashion, assist in the protection from hypoglycemia and accelerate the burning of fat.

Such methods for treating hyperglycemia, including diabetes, diabetes mellitus type I, diabetes mellitus type II, or gestational diabetes, either insulin-dependent or non-insulin dependent, are expected to be useful in reducing complications of diabetes including nephropathy, retinopathy and vascular disease. Applications in cardiovascular disease encompass microvascular as well as macrovascular disease (Davidson, M. H., (2011) Am J Cardiol 108[suppl]:33B-41B; Gejl, M., et al. (2012) J Clin Endocrinol Metab 97:doi:10.1210/jc.2011-3456), and include treatment for myocardial infarction. Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases.

As used herein, the term glucagon or GLP-1 analogs includes all pharmaceutically acceptable salts or esters thereof.

Peptides and Analogs Thereof

In one aspect, the peptides that are covalently modified and are suitable for methods described herein are truncated analogs of glucagon and/or the related hormone GLP-1, including and not limited to:

Glucagon:

(SEQ. ID. NO. 782)
$His_1$-$Ser_2$-$Gln_3$-$Gly_4$-$Thr_5$ $Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Ser_{16}$-$Arg_{17}$-$Arg_{18}$-$Ala_{19}$-$Gln_{20}$-$Asp_{21}$-$Phe_{22}$-$Val_{23}$-$Gln_{24}$-$Trp_{25}$-$Leu_{26}$-$Met_{27}$-$Asn_{28}$-$Thr_{29}$

Oxyntomodulin:

(SEQ. ID. NO. 783)
$His_1$-$Ser_2$-$Gln_3$-$Gly_4$-$Thr_5$ $Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Ser_{16}$-$Arg_{17}$-$Arg_{18}$-$Ala_{19}$-$Gln_{20}$-$Asp_{21}$-$Phe_{22}$-$Val_{23}$-$Gln_{24}$-$Trp_{25}$-$Leu_{26}$-$Met_{27}$-$Asn_{28}$-$Thr_{29}$-$Lys_{30}$-$Arg_{31}$-$Asn_{32}$-$Arg_{33}$-$Asn_{34}$-$Asn_{35}$-$Ile_{36}$-$Ala_{37}$

GLP-1 (Using Glucagon Numbering):

(SEQ. ID. NO. 1)
$His_1$-$Ala_2$-$Glu_3$-$Gly_4$-$Thr_5$ $Phe_6$-$Thr_7$-$Ser_8$-$Asp_9$-$Val_{10}$-$Ser_{11}$-$Ser_{12}$-$Tyr_{13}$-$Leu_{14}$-$Glu_{15}$-$Gly_{16}$-$Gln_{17}$-$Ala_{18}$-$Ala_{19}$-$Lys_{20}$-$Glu_{21}$-$Phe_{22}$-$Ile_{23}$-$Ala_{24}$-$Trp_{25}$-$Leu_{26}$-$Val_{27}$-$Lys_{28}$-$Gly_{29}$-$Arg_{30}$

In some embodiments, a peptide product described herein has the structure:

Formula II
(SEQ. ID. NO. 1)
$aa_1$-$aa_2$-$aa_3$-$aa_4$-$aa_5$-$aa_6$-$aa_7$-$aa_8$-$aa_9$-$aa_{10}$-$aa_{11}$-$aa_{12}$-$aa_{13}$-$aa_{14}$-$aa_{15}$-$aa_{16}$-$aa_{17}$-$aa_{18}$-$aa_{19}$-$aa_{20}$-$aa_{21}$-$aa_{22}$-$aa_{23}$-$aa_{24}$-$aa_{25}$-$aa_{26}$-$aa_{27}$-$aa_{28}$-$aa_{29}$-$aa_{30}$-$aa_{31}$-$aa_{32}$-$aa_{33}$-$aa_{34}$-$aa_{35}$-$aa_{36}$-$aa_{37}$-Z wherein:
- Z is OH, N—$R^4$-His, or —NH—$R^3$, wherein $R^3$ is H, $C_1$-$C_{12}$ substituted or unsubstituted alkyl, or a PEG chain of less than 10 Da; and $R^4$ is a $C_2$-$C_{10}$ acyl group, for example Ac or Bz;
- $aa_1$ is His, N—$R^4$-His, pGlu-His, or N—$R^3$-His;
- $aa_2$ is Ser, D-Ser, Ala, Gly, Pro, MePro, Aib, Ac4c, or Ac5c;
- $aa_3$ is Gln, or Cit;
- $aa_4$ is Gly, or D-Ala;
- $aa_5$ is Thr, or Ser;
- $aa_6$ is Phe, Trp, 2FPhe, MePhe, 2FMePhe, or Nal2;
- $aa_7$ is Thr, or Ser;
- $aa_8$ is Ser, or Asp;
- $aa_9$ is Asp, or Glu;
- $aa_{10}$ is Tyr, Leu, Met, Nal2, Bip, Bip2EtMeO or U;
- $aa_{11}$ is absent or Ser, Asn, Bip or U;
- $aa_{12}$ is absent or Lys, Glu, Ser, Arg, or U;
- $aa_{13}$ is absent or Tyr, Gln, Cit, or U;
- $aa_{14}$ is absent or Leu, Met, Nle, or U;
- $aa_{15}$ is absent or Asp, Glu, or U;
- $aa_{16}$ is absent or Ser, Gly, Glu, Ala, Aib, Ac5c, Lys, Arg, or U;
- $aa_{17}$ is absent or Arg, hArg, Gln, Glu, Cit, Aib, Ac4c, Ac5c, Lys, or U;
- $aa_{18}$ is absent or Arg, hArg, Ala, Aib, Ac4c, Ac5c, or U;
- $aa_{19}$ is absent or Ala, Val, Aib, Ac4c, Ac5c, or U;
- $aa_{20}$ is absent or Gln, Lys, Arg, Cit, Glu, Aib, Ac4c, Ac5c, or U;
- $aa_{21}$ is absent or Asp, Glu, Leu, Aib, Ac4c, Ac5c, or U;
- $aa_{22}$ is absent or Phe, Trp, Nal2, Aib, Ac4c, Ac5c, or U
- $aa_{23}$ is absent or Val, Ile, Aib, Ac4c, Ac5c, or U;
- $aa_{24}$ is absent or Gln, Ala, Glu, Cit, or U;
- $aa_{25}$ is absent or Trp, Nal2, or U;
- $aa_{26}$ is absent or Leu, or U;
- $aa_{27}$ is absent or Met, Val, Leu, Nle, Lys, or U;
- $aa_{28}$ is absent or Asn, Lys, Gln, Cit, or U;
- $aa_{29}$ is absent or Thr, Gly, Aib, Ac4c, Ac5c, or U;
- $aa_{30}$ is absent or Lys, Aib, Ac4c, Ac5c, Arg, or U;
- $aa_{31}$ is absent or Arg, Aib, Ac4c, Ac5c, or U;
- $aa_{32}$ is absent or Asn, Aib, Ac4c, Ac5c, or U;
- $aa_{33}$ is absent or Arg, Aib, Ac4c, Ac5c, or U;
- $aa_{34}$ is absent or Asn, Aib, Ac4c, Ac5c, or U;
- $aa_{35}$ is absent or Asn, Aib, Ac4c, Ac5c, or U;
- $aa_{36}$ is absent or Ile, Ala, Aib, Ac4c, Ac5C, or U;
- $aa_{37}$ absent or U;
- U is a natural or unnatural amino acid comprising a functional group used for covalent attachment to the surfactant X;

wherein any two of $aa_1$-$aa_{37}$ are optionally cyclized through their side chains to form a lactam linkage; and provided that one, or at least one of $aa_{10}$-$aa_{37}$ is the linker amino acid U covalently attached to X.

In specific embodiments, the linking amino acid U, is a diamino acid like Lys or Orn, X is a modified surfactant from the 1-alkyl glycoside class linked to U, and Z is OH, or —NH—$R_2$, wherein $R^3$ is H or $C_1$-$C_{12}$; or a PEG chain of less than 10 Da.

In some embodiments, the peptide product of Formula I-A has the structure of Formula III-A:

Formula III-A
(SEQ. ID. NO. 2)
$aa_1$-$aa_2$-$aa_3$-$aa_4$-$aa_5$-$aa_6$-$aa_7$-$aa_8$-$aa_9$-$aa_{10}$-$aa_{11}$-$aa_{12}$-$aa_{13}$-$aa_{14}$-$aa_{15}$-$aa_{16}$-$aa_{17}$-$aa_{18}$-$aa_{19}$-$aa_{20}$-$aa_{21}$-$aa_{22}$-$aa_{23}$-$aa_{24}$-$aa_{25}$-$aa_{26}$-$aa_{27}$-$aa_{28}$-$aa_{29}$-Z wherein:
- Z is OH, or —NH—$R^3$, wherein $R^3$ is H, or $C_1$-$C_{12}$ substituted or unsubstituted alkyl, or a PEG chain of less than 10 Da;
- $aa_1$ is His, N—Ac-His, pGlu-His, or N—$R^3$-His;
- $aa_2$ is Ser, Ala, Gly, MePro, Aib, Ac4c, or Ac5c;
- $aa_3$ is Gln, or Cit;
- $aa_4$ is Gly, or D-Ala;
- $aa_5$ is Thr, or Ser;
- $aa_6$ is Phe, Trp, 2FPhe, MePhe, 2FMePhe, or Nal2;

$aa_7$ is Thr, or Ser;
$aa_8$ is Ser, or Asp;
$aa_9$ is Asp, or Glu;
$aa_{10}$ is Tyr, Leu, Met, Nal2, Bip, Bip2EtMeO or U(X);
$aa_{11}$ is absent or Ser, Asn, Bip or U(X);
$aa_{12}$ is absent or Lys, Glu, Ser, Arg, or U(X);
$aa_{13}$ is absent or Tyr, Gln, Cit, or U(X);
$aa_{14}$ is absent or Leu, Met, Nle, or U(X);
$aa_{15}$ is absent or Asp, Glu, or U(X);
$aa_{16}$ is absent or Ser, Gly, Glu, Ala, Aib, Ac5c, Lys, Arg, or U(X);
$aa_{17}$ is absent or Arg, hArg, Gln, Glu, Lys, Cit, Aib, Ac4c, Ac5c, or U(X);
$aa_{18}$ is absent or Arg, hArg, Ala, Aib, Ac4c, Ac5c, or U(X);
$aa_{19}$ is absent or Ala, Val, Aib, Ac4c, Ac5c, or U(X);
$aa_{20}$ is absent or Gln, Lys, Arg, Cit, Glu, Aib, Ac4c, Ac5c, or U(X);
$aa_{21}$ is absent or Asp, Glu, Leu, Aib, Ac4c, Ac5c, or U(X);
$aa_{22}$ is absent or Phe, Trp, Nal2, Aib, Ac4c, Ac5c, or U(X);
$aa_{23}$ is absent or Val, Ile, Aib, Ac4c, Ac5c, or U(X);
$aa_{24}$ is absent or Gln, Ala, Glu, Cit, or U(X);
$aa_{25}$ is absent or Trp, Nal2, or U(X);
$aa_{26}$ is absent or Leu, or U(X);
$aa_{27}$ is absent or Met, Val, Leu, Nle, Lys, or U(X);
$aa_{28}$ is absent or Asn, Lys, Gln, or U(X);
$aa_{29}$ is absent or Thr, Gly, Aib, Ac4c, Ac5c, or U(X);
wherein any two of $aa_1$-$aa_{29}$ are optionally cyclized through their side chains to form a lactam linkage; and
provided that one, or at least one of $aa_{10}$, $aa_{11}$, $aa_{12}$, $aa_{16}$, $aa_{17}$, $aa_{18}$, $aa_{19}$, $aa_{20}$, $aa_{21}$, $aa_{22}$, $aa_{23}$, $aa_{24}$, $aa_{25}$, $aa_{26}$, $aa_{27}$, $aa_{28}$ or $aa_{29}$ is the natural or unnatural amino acid U covalently attached to X.

In some embodiments, a peptide product described herein has the structure of Formula III-B:

Formula III-B (SEQ. ID. NO. 3)

$His_1$-$aa_2$-$aa_3$-$Gly_4$-$Thr_5$-$aa_6$-$Thr_7$-$Ser_8$-$Asp_9$-$aa_{10}$-$aa_{11}$-$aa_{12}$-$aa_{13}$-$aa_{14}$-$aa_{15}$-$aa_{16}$-$aa_{17}$-$aa_{18}$-$aa_{19}$-$aa_{20}$-$aa_{21}$-$aa_{22}$-$aa_{23}$-$aa_{24}$-$aa_{25}$-$aa_{26}$-$aa_{27}$-$aa_{28}$-$aa_{29}$-$aa_{30}$-Z wherein:
Z is OH, or —NH—$R^3$, wherein $R^3$ is H or substituted or unsubstituted $C_1$-$C_{12}$ alkyl; or a PEG chain of less than 10 Da;
$aa_2$ is Gly, MePro or Aib;
$aa_3$ is Gln or Cit;
$aa_6$ is Phe, 2FPhe, MePhe, 2FMePhe, or Nal2;
$aa_{10}$ is Tyr, Nal2, Bip, Bip2EtMeO or U(X);
$aa_{11}$ is absent or Ser, Asn, Bip or U(X);
$aa_{12}$ is absent or Lys, Glu, Ser or U(X);
$aa_{13}$ is absent or Tyr, Gln, Cit, or U(X);
$aa_{14}$ is absent or Leu, Nle, or U(X);
$aa_{15}$ is absent or Asp, Glu, or U(X);
$aa_{16}$ is absent or Ser, Gly, Glu, Ala, Aib, Lys, Arg, or U(X);
$aa_{17}$ is absent or Arg, hArg, Gln, Glu, Lys, Cit, Aib, or U(X);
$aa_{18}$ is absent or Arg, hArg, Ala, Aib, Ac4c, Ac5c, or U(X);
$aa_{19}$ is absent or Ala, Aib, or U(X);
$aa_{20}$ is absent or Gln, Lys, Arg, Cit, Glu, Aib, or U(X);

$aa_{21}$ is absent or Asp, Glu, Leu, Aib, or U(X);
$aa_{22}$ is absent or Phe, or U(X)
$aa_{23}$ is absent or Val, Ile, Aib or U(X);
$aa_{24}$ is absent or Ala, Gln or U(X);
$aa_{25}$ is absent or Trp or U(X);
$aa_{26}$ is absent or Len or U(X);
$aa_{27}$ is absent or Met, Val, Leu, Nle, Lys or U(X);
$aa_{28}$ is absent or Asn, Gln, Cit, or U(X);
$aa_{29}$ is absent or Thr, Aib, or U(X);
$aa_{30}$ is absent or Arg, or U(X);
wherein any two of $aa_1$-$aa_{23}$ are optionally cyclized through their side chains to form a lactam linkage; and
provided that one, or at least one of $aa_{10}$, $aa_{11}$, $aa_{12}$, $aa_{16}$, $aa_{17}$, $aa_{18}$, $aa_{19}$, $aa_{20}$, $aa_{21}$, $aa_{22}$, $aa_{23}$, $aa_{24}$, or $aa_{28}$ is the natural or unnatural amino acid U covalently attached to X.

In some specific embodiments of Formula III-A and Formula III-B, X has the structure:

Formula I

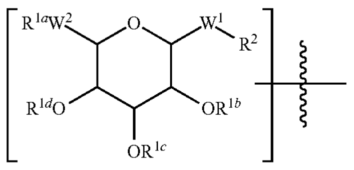

wherein:
$R^{1a}$ is a substituted or unsubstituted $C_1$-$C_{30}$ alkyl group;
$R^{1b}$, $R^{1c}$, and $R^{1d}$ are H;
$W^1$ is —(C═O)—NH—;
$W^2$ is —O—; and
$R^2$ is a bond.

In some of the embodiments described above, $R^{1a}$ is a $C_1$-$C_{20}$ alkyl group, a $C_8$-$C_{20}$ alkyl group, $C_{12-18}$ alkyl group or $C_{14}$-$C_{18}$ alkyl group.

In some embodiments of Formula III-B, U is any linker amino acid described herein. Table 1 in FIG. 1, Table 2 in FIG. 2, and Table 3 in FIG. 3 illustrate certain examples of peptides that covalently linked with surfactants as described herein.

In some embodiments of Formula I-A, III-A, or III-B, the peptide product has the structure:

(SEQ. ID. NO. 795)

$His_1$-$aa_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu_{16}$-$U(X)_{17}$-$Ala_{18}$-$Ala_{19}$-$Lys_{20}$-$Glu_{21}$-$Phe_{22}$-$Ile_{23}$-$Ala_{24}$-$Trp_{25}$-$Leu_{26}$-$Leu_{27}$-$aa_{28}$-$Thr_{29}$-$NH_2$;

wherein
$aa_2$ is Gly or Aib;
$aa_{28}$ is Asn or Gln.

In some embodiments of Formula I-A, III-A, or III-B, the peptide product has the structure:

(SEQ. ID. NO. 796)

$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$aa_{16}$-$Gln_{17}$ $Ala_{18}$-$Ala_{19}$-

-continued $aa_{20}$-$Glu_{21}$-$Phe_{22}$-$Ile_{23}$-Lys(N-omega-X)$_{24}$-$Trp_{25}$-$Leu_{26}$-$Leu_{27}$-$aa_{28}$-$Thr_{29}$-$NH_2$;

wherein $aa_{16}$ and $aa_{20}$ are each individually either Lys or Glu and are cyclized through their side chains to form a lactam linkage;

and $aa_{28}$ is Asn or Gln;

X comprises a glucuronyl class moiety prepared from 1-alkyl beta-D-glucosides, 1-alkyl beta-D-maltosides, 1-alkyl beta-D-melibiosides, or the corresponding alpha glycosides, and the like, and where alkyl is a $C_8$-$C_{20}$ linear alkyl chain.

In some embodiments of Formula I-A, III-A, or III-B, the peptide product has the structure:

(SEQ. ID. NO. 797)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega-X)$_{24}$-$Trp_{25}$-$Leu_{26}$-$Leu_{27}$-$Gln_{28}$-$Thr_{29}$-$NH_2$;

wherein $aa_{16}$ and $aa_{20}$ are cyclized through their side chains to form a lactam linkage;

and X comprises a glucuronyl class moiety prepared from 1-alkyl beta-D-glucosides, 1-alkyl beta-D-maltosides, 1-alkyl beta-D-melibiosides, or the corresponding alpha glycosides, and the like, and where alkyl is a $C_8$-$C_{20}$ linear alkyl chain.

In some embodiments of Formula I-A, III-A, or III-B, the peptide product has the structure:

(SEQ. ID. NO. 600)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-octyl beta-D-glucuronyl))$_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 601)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-dodecyl beta-D-glucuronyl))$_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 602)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-tetradecyl beta-D-glucuronyl))$_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 603)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-hexadecyl beta-D-glucuronyl))$_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 604)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-octadecyl beta-D-glucuronyl))$_{24}$-$Trp_{25}$-$Leu_{26}$-$Leu_{27}$-$Gln_{28}$-$Thr_{29}$-$NH_2$;.

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 631)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-dodecyl beta-D-melibiouronyl))$_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 632)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-tetradecyl beta-D-melibiouronyl)$)_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 633)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-hexadecyl beta-D-melibiouronyl)$)_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 634)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-octadecyl beta-D-melibiouronyl)$)_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 637)
$His_1$-$Gly_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu_{16}$-$Gln_{17}$ $Ala_{18}$-$Ala_{19}$-$Arg_{20}$-$Glu_{21}$-$Phe_{22}$-$Ile_{23}$-Lys(N-omega(1-dodecyl beta-D-melibiouronyl)$)_{24}$-$Trp_{25}$-$Leu_{26}$-$Leu_{27}$-$Gln_{28}$-$Thr_{29}$-$NH_2$;.

In some embodiments of Formula I-A, III-A, or III-B, the peptide product has the structure:

(SEQ. ID. NO. 640)
$His_1$-$Gly_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu_{16}$-$Gln_{17}$ $Ala_{18}$-$Ala_{19}$-$Arg_{20}$-$Glu_{21}$-$Phe_{22}$-$Ile_{23}$-Lys(N-omega(1-octadecyl beta-D-melibiouronyl)$)_{24}$-$Trp_{25}$-$Leu_{26}$-$Leu_{27}$-$Gln_{28}$-$Thr_{29}$-$NH_2$;.

In some embodiments of Formula I-A, III-A, or III-B, the peptide product has the structure:

(SEQ. ID. NO. 799)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-decyl beta-D-glucuronyl)$)_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

In some embodiments of Formula I-A, III-A, or III-B, the peptide product has the structure:

(SEQ. ID. NO. 800)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-$Gln_{17}$ $Ala_{18}$-$Ala_{19}$-$Lys*_{20}$-$Glu_{21}$-$Phe_{22}$-$Ile_{23}$-Lys(N-omega(1-undecyl beta-D-glucuronyl)$)_{24}$-$Trp_{25}$-$Leu_{26}$-$Leu_{27}$-$Gln_{28}$-$Thr_{29}$-$NH_2$;

wherein $Glu*_{16}$ and $Lys*_{20}$ are cyclized through their side chains to form a lactam linkage.

Contemplated within the scope of embodiments presented herein are peptide products of Formula I-A, Formula III-A, or Formula III-B, wherein the peptide product comprises one, or, more than one surfactant groups (e.g., group X having the structure of Formula I). In one embodiment, a peptide product of Formula I-A, Formula III-A, or Formula III-B, comprises one surfactant group. In another embodiment, a peptide product of Formula I-A, Formula III-A, or Formula III-B, comprises two surfactant groups. In yet another embodiment, a peptide product of Formula I-A, Formula III-A, or Formula III-B, comprises three surfactant groups.

Recognized herein is the importance of certain portions of SEQ. ID. NO. 1 for the treatment of conditions associated with insulin resistance and/or cardiovascular conditions. Accordingly, provided herein is a method of treating diabetes in an individual in need thereof comprising administration of a therapeutically effective amount of a glucagon analog comprising amino acid residues $aa_1$-$aa_{17}$ of SEQ. ID. NO. 1 to the individual in need thereof.

In a further embodiment, provided herein is a method of treating diabetes in an individual in need thereof comprising administration of a therapeutically effective amount of a glucagon analog comprising amino acid residues $aa_1$-$aa_{18}$ of SEQ. ID. NO. 1 to the individual in need thereof.

In another embodiment, provided herein is a method of treating diabetes in an individual in need thereof comprising administration of a therapeutically effective amount of a glucagon analog comprising amino acid residues $aa_1$-$aa_{19}$ of SEQ. ID. NO. 1 to the individual in need thereof.

In another embodiment, provided herein is a method of treating diabetes in an individual in need thereof comprising administration of a therapeutically effective amount of a glucagon analog comprising amino acid residues $aa_1$-$aa_{20}$ of SEQ. ID. NO. 1 to the individual in need thereof.

In an additional embodiment, the administration of the said glucagon analog described above causes weight loss.

Recognized herein is the importance of certain portions of SEQ. ID. NO. 1 for the treatment of conditions associated with insulin resistance and/or cardiovascular conditions. Accordingly, provided herein is a method of treating diabetes in an individual in need thereof comprising administration of a therapeutically effective amount of a glucagon analog comprising amino acid residues $aa_1$-$aa_{17}$ of SEQ. ID. NO. 1 to the individual in need thereof.

In a further embodiment, provided herein is a method of treating diabetes in an individual in need thereof comprising administration of a therapeutically effective amount of a glucagon analog comprising amino acid residues $aa_1$-$aa_{18}$ of SEQ. ID. NO. 1 to the individual in need thereof.

In another embodiment, provided herein is a method of treating diabetes in an individual in need thereof comprising administration of a therapeutically effective amount of a glucagon analog comprising amino acid residues $aa_1$-$aa_{19}$ of SEQ. ID. NO. 1 to the individual in need thereof.

In another embodiment, provided herein is a method of treating diabetes in an individual in need thereof comprising administration of a therapeutically effective amount of a glucagon analog comprising amino acid residues $aa_1$-$aa_{20}$ of SEQ. ID. NO. 1 to the individual in need thereof.

In an additional embodiment, the administration of the said glucagon analog described above causes weight loss.

In any of the embodiments described above, the said glucagon analog is modified with a surfactant X of Formula I:

Formula I

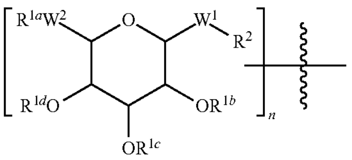

wherein:

$R^{1a}$ is independently, at each occurrence, a bond, H, a saccharide, a substituted or unsubstituted $C_1$-$C_{30}$ alkyl group, a substituted or unsubstituted alkoxyaryl group, a substituted or unsubstituted aralkyl group, or a steroid nucleus containing moiety;

$R^{1b}$, $R^{1c}$, and $R^{1d}$ are each, independently at each occurrence, a bond, H, a substituted or unsubstituted $C_1$-$C_{30}$ alkyl group, a substituted or unsubstituted alkoxyaryl group, or a substituted or unsubstituted aralkyl group;

$W^1$ is independently, at each occurrence, —$CH_2$—, —$CH_2$—O—, —(C═O), —(C═O)—O—, —(C═O)—NH—, —(C═S)—, —(C═S)—NH—, or —$CH_2$—S—;

$W^2$ is —O—, —$CH_2$— or —S—;

$R^2$ is independently, at each occurrence, a bond to U, H, a substituted or unsubstituted $C_1$-$C_{30}$ alkyl group, a substituted or unsubstituted alkoxyaryl group, or a substituted or unsubstituted aralkyl group, —$NH_2$, —SH, $C_2$-$C_4$-alkene, $C_2$-$C_4$-alkyne, —NH(C═O)—$CH_2$—Br, —$(CH_2)_m$-maleimide, or —$N_3$;

n is 1, 2 or 3; and m is an integer of 1-10.

In a specific embodiment, the said glucagon analog is modified with a surfactant, X having the structure:

Formula I

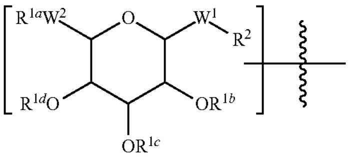

wherein:

$R^{1a}$ is a substituted or unsubstituted $C_1$-$C_{30}$ alkyl group;

$R^{1b}$, $R^{1c}$, and $R^{1d}$ are H;

$W^1$ is —(C═O)—NH—;

$W^2$ is —O—; and $R^2$ is a bond.

In some of the embodiments described above, $R^{1a}$ is a $C_1$-$C_{20}$ alkyl group, a $C_8$-$C_{20}$ alkyl group, $C_{12}$-$C_{18}$ alkyl group or $C_{14}$-$C_{18}$ alkyl group.

In some embodiments described above and herein, $R^{1a}$ is a saccharide. In some embodiments, the saccharide is a galactose. In certain embodiments, the saccharide is an alpha-linked galactose. In other embodiments, the saccharide is alpha-linked galactopyranose, beta-linked galactopyranose, alpha-linked galactofuranose, or beta-linked galactofuranose.

As used herein, the term diabetes includes both Type 1 and Type 2 diabetes. Accordingly, in some embodiments the methods described herein comprise administration of any compound described herein including compounds of Formula II, III-A, and/or III-B, and/or compounds described in Table 1 of FIG. 1, Table 2 of FIG. 2, and Table 3 of FIG. 3 to an individual suffering from Type 1 diabetes. In some other embodiments, the methods described herein comprise administration of any compound described herein including compounds of Formula II, III-A, and/or III-B, and/or compounds described in Table 1 of FIG. 1, Table 2 of FIG. 2, and Table 3 of FIG. 3 to an individual suffering from Type 2 diabetes.

Also provided herein is a method of treating a cardiovascular disease in an individual in need thereof comprising administration of a therapeutically effective amount of a glucagon analog comprising amino acid residues $aa_1$-$aa_{17}$ of SEQ. ID. NO. 1 to the individual in need thereof.

Also provided herein is a method of treating a cardiovascular disease in an individual in need thereof comprising administration of a therapeutically effective amount of a glucagon analog comprising amino acid residues $aa_1$-$aa_{18}$ of SEQ. ID. NO. 1 to the individual in need thereof.

Also provided herein is a method of treating a cardiovascular disease in an individual in need thereof comprising administration of a therapeutically effective amount of a glucagon analog comprising amino acid residues $aa_1$-$aa_{19}$ of SEQ. ID. NO. 1 to the individual in need thereof.

Also provided herein is a method of treating a cardiovascular disease in an individual in need thereof comprising administration of a therapeutically effective amount of a glucagon analog comprising amino acid residues $aa_1$-$aa_{20}$ of SEQ. ID. NO. 1 to the individual in need thereof.

In some cases for the embodiments described above, the said glucagon analog is administered when the cardiovascular disease is associated with an ischemic event.

Also provided herein is a method of treating a cardiovascular disease in an individual in need thereof comprising administration of a therapeutically effective amount of a glucagon analog comprising amino acid residues $aa_1$-$aa_{17}$ of SEQ. ID. NO. 1 to the individual in need thereof.

Also provided herein is a method of treating a cardiovascular disease in an individual in need thereof comprising administration of a therapeutically effective amount of a glucagon analog comprising amino acid residues $aa_1$-$aa_{18}$ of SEQ. ID. NO. 1 to the individual in need thereof.

Also provided herein is a method of treating a cardiovascular disease in an individual in need thereof comprising administration of a therapeutically effective amount of a glucagon analog comprising amino acid residues $aa_1$-$aa_{19}$ of SEQ. ID. NO. 1 to the individual in need thereof.

Also provided herein is a method of treating a cardiovascular disesase in an individual in need thereof comprising administration of a therapeutically effective amount of a glucagon analog comprising amino acid residues $aa_1$-$aa_{20}$ of SEQ. ID. NO. 1 to the individual in need thereof.

In some cases for the embodiments described above, the said glucagon analog is administered when the cardiovascular disease is associated with an ischemic event.

In any of the embodiments described above, the said glucagon analog is modified with a surfactant X of Formula I:

Formula I

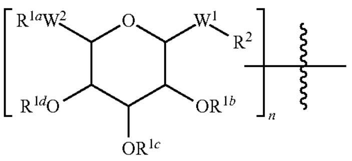

wherein:

$R^{1a}$ is independently, at each occurrence, a bond, H, a saccharide, a substituted or unsubstituted $C_1$-$C_{30}$ alkyl group, a substituted or unsubstituted alkoxyaryl group, a substituted or unsubstituted aralkyl group, or a steroid nucleus containing moiety;

$R^{1b}$, $R^{1c}$, and $R^{1d}$ are each, independently at each occurrence, a bond, H, a substituted or unsubstituted $C_1$-$C_{30}$ alkyl group, a substituted or unsubstituted alkoxyaryl group, or a substituted or unsubstituted aralkyl group;

$W^1$ is independently, at each occurrence, $-CH_2-$, $-CH_2-O-$, $-(C{=}O)$, $-(C{=}O)-O-$, $-(C{=}O)-NH-$, $-(C{=}S)-$, $-(C{=}S)-NH-$, or $-CH_2-S-$;

$W^2$ is $-O-$, $-CH_2-$ or $-S-$;

$R^2$ is independently, at each occurrence, a bond to U, H, a substituted or unsubstituted $C_1$-$C_{30}$ alkyl group, a substituted or unsubstituted alkoxyaryl group, or a substituted or unsubstituted aralkyl group, $-NH_2$, $-SH$, $C_2$-$C_4$-alkene, $C_2$-$C_4$-alkyne, $-NH(C{=}O)-CH_2-Br$, $-(CH_2)_m$-maleimide, or $-N_3$;

n is 1, 2 or 3; and m is 1-10.

In a specific embodiment, the said glucagon analog is modified with a surfactant, X having the structure:

Formula I

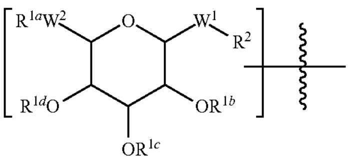

wherein:

$R^{1a}$ is a substituted or unsubstituted $C_1$-$C_{30}$ alkyl group;

$R^{1b}$, $R^{1c}$, and $R^{1d}$ are H;

$W^1$ is $-(C{=}O)-NH-$;

$W^2$ is $-O-$; and $R^2$ is a bond.

In some of the embodiments described above, $R^{1a}$ is a $C_1$-$C_{20}$ alkyl group, a $C_8$-$C_{20}$ alkyl group, $C_{12}$-$C_{18}$ alkyl group or $C_{14}$-$C_{18}$ alkyl group.

In some embodiments described above and herein, $R^{1a}$ is a saccharide. In some embodiments, the saccharide is a galactose. In certain embodiments, the saccharide is an alpha-linked galactose. In other embodiments, the saccharide is alpha-linked galactopyranose, beta-linked galactopyranose, alpha-linked galactofuranose, or beta-linked galactofuranose.

Modifications at the amino or carboxyl terminus may optionally be introduced into the peptides (e.g., glucagon or GLP-1) (Nestor, J. J., Jr. (2009) Current Medicinal Chemistry 16: 4399-4418). For example, the peptides can be truncated or acylated on the N-terminus to yield peptides analogs exhibiting low efficacy, partial agonist and antagonist activity, as has been seen for some peptides (Gourlet, P., et al. (1998) Eur J Pharmacol 354: 105-111, Gozes, I. and Furman, S. (2003) Curr Pharm Des 9: 483-494), the contents of which is incorporated herein by reference). For example, deletion of the first 6 residues of bPTH yields antagonistic analogs (Mahaffey, J. E., et al. (1979) J Biol Chem 254: 6496-6498; Goldman, M. E., et al. (1988) Endocrinology 123: 2597-2599) and a similar operation on peptides described herein generates potent antagonistic analogs. Other modifications to the N-terminus of peptides, such as deletions or incorporation of D-amino acids such as D-Phe also can give potent and long acting agonists or antagonists when substituted with the modifications described herein such as long chain alkyl glycosides. Such agonists and antagonists also have commercial utility and are within the scope of contemplated embodiments described herein.

Also contemplated within the scope of embodiments described herein are surfactants covalently attached to peptide analogs, wherein the native peptide is modified by acetylation, acylation, PEGylation, ADP-ribosylation, amidation, covalent attachment of a lipid or lipid derivative, covalent attachment of phosphotidylinositol, cross-linking, cyclization, disulfide bond formation, demethylation, formation of covalent cross-link formation of cysteine, formation of pyroglutamate, formylation, gamma-carboxylation, glycosylation, GPI anchor formation, hydroxylation, iodination, methylation, myristoylation, oxidation, proteolytic processing, phosphorylation, prenylation, racemization, glycosylation, lipid attachment, sulfation, gamma-carboxylation of glutamic acid residues, hydroxylation and ADP-ribosylation, selenoylation, sulfation, transfer-RNA mediated addition of amino acids to proteins, such as arginylation, and ubiquitination. See, for instance, (Nestor, J. J., Jr. (2007) Comprehensive Medicinal Chemistry II 2: 573-601, Nestor, J. J., Jr. (2009) Current Medicinal Chemistry 16: 4399-4418, Creighton, T. E. (1993, Wold, F. (1983) Posttranslational Covalent Modification of Proteins 1-12, Seifter, S. and Englard, S. (1990) Methods Enzymol 182: 626-646, Rattan, S. I., et al. (1992) Ann N Y Acad Sci 663: 48-62). Also contemplated within the scope of embodiments described herein are peptides that are branched or cyclic, with or without branching. Cyclic, branched and branched circular peptides result from post-translational natural processes and are also made by suitable synthetic methods. In some embodiments, any peptide product described herein comprises a peptide analog described above that is then covalently attached to an alkyl-glycoside surfactant moiety.

Also contemplated within the scope of embodiments presented herein are peptide chains substituted in a suitable position by the substitution of the analogs claimed herein by acylation on a linker amino acid, at for example the F-position of Lys, with fatty acids such as octanoic, decanoic, dodecanoic, tetradecanoic, hexadecanoic, octadecanoic, 3-phenylpropanoic acids and the like, with saturated or unsaturated alkyl chains (Zhang, L. and Bulaj, G. (2012) Curr Med Chem 19: 1602-1618). Similarly, such acylation may be linked to a spacer such as gamma-linked glutamic acid or on a gamma linked glutamic acid further linked to a "mini-PEG" chain such as 9-amino-4,7-dioxanonanoic acid (DiMarchi, R. D. and Ward, B. P (2012) US Patent Application US2012/0238493). Non-limiting, illustrative examples of such analogs are:

(SEQ. ID. NO. 785)
$His_1$-$Gly_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu_{16}$-Lys(N-epsilon-dodecanoyl)$_{17}$-$Ala_{18}$-$Ala_{19}$-$Lys_{20}$-$Glu_{21}$-$Phe_{22}$-$Ile_{23}$-$Ala_{24}$-$Trp_{25}$-$Leu_{26}$-$Leu_{27}$-$Asn_{28}$-$Thr_{29}$-$NH_2$, (SEQ. ID. NO. 786)
$His_1$-$Gly_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu_{16}$-Lys(N-epsilon-hexadecanoyl)$_{17}$-$Ala_{18}$-$Ala_{19}$-$Lys_{20}$-$Glu_{21}$-$Phe_{22}$-$Ile_{23}$-$Ala_{24}$-$Trp_{25}$-$Leu_{26}$-$Leu_{27}$-$Asn_{28}$-$Thr_{29}$-$NH_2$, (SEQ. ID. NO. 787)
$His_1$-$Gly_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu_{16}$-Lys(N-epsilon-octadecanoyl)$_{17}$-$Ala_{18}$-$Ala_{19}$-$Lys_{20}$-$Glu_{21}$-$Phe_{22}$-$Ile_{23}$-$Ala_{24}$-$Trp_{25}$-$Leu_{26}$-$Leu_{27}$-$Asn_{28}$-$Thr_{29}$-$NH_2$, (SEQ. ID. NO. 788)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-cyclo($Glu_{16}$-$Gln_{17}$-$Ala_{18}$-$Ala_{19}$-$Lys_{20}$)-$Glu_{21}$-$Phe_{22}$-$Ile_{23}$-Lys(N-epsilon-hexadecanoyl)$_{24}$-$Trp_{25}$-$Leu_{26}$-$Leu_{27}$-$Asn_{28}$-$Thr_{29}$-$NH_2$, (SEQ. ID. NO. 789)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-cyclo($Glu_{16}$-$Gln_{17}$-

-continued $Ala_{18}$-$Ala_{19}$-$Lys_{20}$)-$Glu_{21}$-$Phe_{22}$-$Ile_{23}$-Lys(N-epsilon (N-alpha-octadecanoyl)-gamma-glutamyl)$_{24}$-$Trp_{25}$-$Leu_{26}$-$Leu_{27}$-$Asn_{28}$-$Thr_{29}$-$NH_2$, (SEQ. ID. NO. 790)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-cyclo($Glu_{16}$-$Gln_{17}$-$Ala_{18}$-$Ala_{19}$-$Lys_{20}$)-$Glu_{21}$-$Phe_{22}$-$Ile_{23}$-Lys(N-epsilon (N-alpha-hexadecanoyl)-gamma-glutamyl)$_{24}$-$Trp_{25}$-$Leu_{26}$-$Leu_{27}$-$Asn_{28}$-$Thr_{29}$-$NH_2$, (SEQ. ID. NO. 791)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-cyclo($Glu_{16}$-$Gln_{17}$-$Ala_{18}$-$Ala_{19}$-$Lys_{20}$)-$Glu_{21}$-$Phe_{22}$-$Ile_{23}$-Lys(N-epsilon-(N-alpha-octadecanoyl(N9-gamma-glutamyl(9-amino-4,7-dioxanonanoyl))))$_{24}$-$Trp_{25}$-$Leu_{26}$-$Leu_{27}$-$Asn_{28}$-$Thr_{29}$-$NH_2$, (SEQ. ID. NO. 792)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-cyclo($Glu_{16}$-$Gln_{17}$-$Ala_{18}$-$Ala_{19}$-$Lys_{20}$)-$Glu_{21}$-$Phe_{22}$-$Ile_{23}$-Lys(N-epsilon (N-alpha-hexadecanoyl(N9-gamma glutamyl(9-amino-4,7-dioxanonanoyl))))$_{24}$-$Trp_{25}$-$Leu_{26}$-$Leu_{27}$-$Asn_{28}$-$Thr_{29}$-$NH_2$,, and the like.

and the like.

In further embodiments, a peptide chain is optionally substituted in a suitable position by reaction on a linker amino acid, for example the sulfhydryl of Cys, with a spacer and a hydrophobic moiety such as a steroid nucleus, for example a cholesterol moiety. In some of such embodiments, the modified peptide further comprises one or more PEG chains. Non-limiting examples of such molecules are:

(SEQ. ID. NO. 793)
$His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-cyclo($Glu_{16}$-$Gln_{17}$-$Ala_{18}$-$Ala_{19}$-$Lys_{20}$)-$Glu_{21}$-$Phe_{22}$-$Ile_{23}$-Cys(S-(3-(PEG4-aminoethylacetamide-cholesterol))$_{24}$-$Trp_{25}$-$Leu_{26}$-$Leu_{27}$-$Asn_{28}$-$Thr_{29}$-$NH_2$, (SEQ. ID. NO. 794)
$His_1$-$Gly_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-cyclo($Glu_{16}$-$Gln_{17}$-$Ala_{18}$-$Ala_{19}$-$Lys_{20}$)-$Glu_{21}$-$Phe_{22}$-$Ile_{23}$-Cys(S-(3-(PEG4-aminoethylacetamide-Cholesterol))$_{24}$-$Trp_{25}$-$Leu_{26}$-$Leu_{27}$-$Asn_{28}$-$Thr_{29}$-$NH_2$,, and the like.

Aside from the twenty standard amino acids, there are a vast number of "nonstandard amino acids" or unnatural amino acids that are known to the art and that may be incorporated in the compounds described herein, as described above. Other nonstandard amino acids are modified with reactive side chains for conjugation (Gauthier, M. A. and Klok, H. A. (2008) Chem Commun (Camb) 2591-2611; de Graaf, A. J., et al. (2009) Bioconjug Chem 20: 1281-1295). In one approach, an evolved tRNA/tRNA synthetase pair and is coded in the expression plasmid by the amber suppressor codon (Deiters, A, et al. (2004). Bio-org. Med. Chem. Lett. 14, 5743-5). For example, p-azidophenylalanine was incorporated into peptides and then reacted with a functionalized surfactant, or a PEG polymer having an acetylene moiety in the presence of a reducing agent and copper ions to facilitate an organic reaction known as "Huisgen [3+2]cycloaddition." A similar reaction sequence using the reagents described herein containing an acetylene modified alkyl glycoside or PEG modified glycoside will result in PEGylated or alkyl glycoside modified peptides. For peptides of less than about 50 residues, standard solid phase synthesis is used for incorporation of said reactive amino acid residues at the desired position in the chain. Such surfactant-modified peptides and/or proteins offer a different spectrum of pharmacological and medicinal properties than peptides modified by PEG incorporation alone.

The skilled artisan will appreciate that numerous permutations of the peptide analogs are possible and, provided that an amino acid sequence has an incorporated surfactant moiety, will possess the desirable attributes of surfactant modified peptide products described herein.

Certain Definitions

As used in the specification, "a" or "an" means one or more. As used in the claim(s), when used in conjunction with the word "comprising," the words "a" or "an" mean one or more. As used herein, "another" means at least a second or more.

As used herein, the one- and three-letter abbreviations for the various common amino acids are as recommended in Pure Appl. Chem. 31, 639-645 (1972) and 40, 277-290 (1974) and comply with 37 CFR § 1.822 (55 FR 18245, May 1, 1990). The abbreviations represent L-amino acids unless otherwise designated as D- or DL. Certain amino acids, both natural and non-natural, are achiral, e.g., glycine, Cα-diethylglycine (Deg), α-amino-isobutyric acid (Aib), 1-aminocyclobutane-1-carboxylic acid (Ac4c), 1-aminocyclopentane-1-carboxylic acid (Ac5c), 1-aminocyclohexane-1-carboxylic acid (Ac6c). Analogs of glutamine include citrulline (Cit). All peptide sequences are presented with the N-terminal amino acid on the left and the C-terminal amino acid on the right. C-alpha-methylproline (MePro) can be used to constrain the peptide linkage as can C-alpha-methylphenylalanine (MePhe), 2-fluorophenylalanine (2FPhe), C-alpha-methyl-2-fluorophenylalanine (2FMePhe), and C-alpha-methyllysine (MeLys). Additional unnatural aromatic amino acids may be substituted, such as 2-naphthylalanine (Nal2), biphenylalanine (Bip), 2-ethyl-4'-methoxybiphenylalanine (Bip2EtMeO) and may yield potency increases.

An "alkyl" group refers to an aliphatic hydrocarbon group. Reference to an alkyl group includes "saturated alkyl" and/or "unsaturated alkyl". The alkyl group, whether saturated or unsaturated, includes branched, straight chain, or cyclic groups. A "substituted" alkyl group is substituted with one or more additional group(s). In certain embodiments, the one or more additional group(s) are individually and independently selected from amide, ester, alkyl, cycloalkyl, heteroalkyl, aryl, heteroaryl, heteroalicyclic, hydroxy, alkoxy, aryloxy, alkylthio, arylthio, alkylsulfoxide, arylsulfoxide, ester, alkylsulfone, arylsulfone, cyano, halogen, alkoyl, alkoyloxo, isocyanato, thiocyanato, isothiocyanato, nitro, haloalkyl, haloalkoxy, fluoroalkyl, amino, alkyl-amino, dialkyl-amino, amido, oxo, hydrophobic natural product such as a steroid, an aralkyl chain (including alkoxyaryl), alkyl chain containing an acyl moiety, or the like. In some embodiments, an alkyl group is linked to the Nα-position of a residue (e.g., Tyr or Dmt) in a peptide. This class is referred to as N-alkyl and comprises straight or branched alkyl groups from $C_1$-$C_{10}$, or an aryl substituted alkyl group such as benzyl, phenylethyl and the like. In some embodiments, an alkyl moiety is a 1-alkyl group that is in glycosidic linkage (typically to the 1-position of, for example, glucose) to the saccharide moiety. Such a 1-alkyl group is a $C_1$-$C_{30}$ alkyl group.

An "aryl" group refers to an aromatic ring wherein each of the atoms forming the ring is a carbon atom. Aryl rings described herein include rings having five, six, seven, eight, nine, or more than nine carbon atoms. Aryl groups are optionally substituted with substituents selected from halogen, alkyl, acyl, alkoxy, alkylthio, sulfonyl, dialkyl-amino, carboxyl esters, cyano or the like. Examples of aryl groups include, but are not limited to phenyl, and naphthalenyl.

The term "acyl" refers to a $C_1$-$C_{20}$ acyl chain. This chain may comprise a linear aliphatic chain, a branched aliphatic chain, a chain containing a cyclic alkyl moiety, a hydrophobic natural product such as a steroid, an aralkyl chain, or an alkyl chain containing an acyl moiety.

The term "steroid nucleus" refers to the core of steroids comprising an arrangement of four fused rings designated A, B, C and D as shown below:

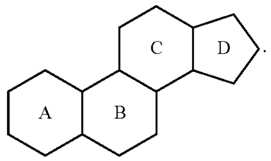

Examples of steroid nucleus containing moieties include, and are not limited to, cholesterol and the like.

As used herein, a "therapeutic composition" can comprise an admixture with an aqueous or organic carrier or excipient, and can be compounded, for example, with the usual non-toxic, pharmaceutically acceptable carriers for tablets, pellets, capsules, lyophilizates, suppositories, solutions, emulsions, suspensions, or other form suitable for use. The carriers, in addition to those disclosed above, can include alginate, collagen, glucose, lactose, mannose, gum acacia, gelatin, mannitol, starch paste, magnesium trisilicate, talc, corn starch, keratin, colloidal silica, potato starch, urea, medium chain length triglycerides, dextrans, and other carriers suitable for use in manufacturing preparations, in solid, semisolid, or liquid form. In addition, auxiliary stabilizing, thickening or coloring agents can be used, for example a stabilizing dry agent such as triulose.

As used herein, a "pharmaceutically acceptable carrier" or "therapeutic effective carrier" is aqueous or nonaqueous (solid), for example alcoholic or oleaginous, or a mixture thereof, and can contain a surfactant, emollient, lubricant, stabilizer, dye, perfume, preservative, acid or base for adjustment of pH, a solvent, emulsifier, gelling agent, moisturizer, stabilizer, wetting agent, time release agent, humectant, or other component commonly included in a particular form of pharmaceutical composition. Pharmaceutically acceptable carriers are well known in the art and include, for example, aqueous solutions such as water or physiologically buffered saline or other solvents or vehicles such as glycols, glycerol, and oils such as olive oil or injectable organic esters. A pharmaceutically acceptable carrier can contain physiologically acceptable compounds that act, for example, to stabilize or to increase the absorption of specific inhibitor, for example, carbohydrates, such as glucose, sucrose or dextrans, antioxidants, such as ascorbic acid or glutathione, chelating agents, low molecular weight proteins or other stabilizers or excipients.

As used herein, a "insulin-resensitizing" amount of a peptide product is an amount that increases the body's response to endogenous or exogenously administered insulin, typically while reducing body weight, in an individual in need thereof as evidenced by, for example, an oral glucose challenge test or euglycemic clamp test.

The pharmaceutical compositions can also contain other pharmaceutically acceptable auxiliary substances as required to approximate physiological conditions, such "substances" include, but are not limited to, pH adjusting and buffering agents, tonicity adjusting agents and the like, for example, sodium acetate, sodium lactate, sodium chloride, potassium chloride, calcium chloride, etc. Additionally, the peptide, or variant thereof, suspension may include lipid-protective agents which protect lipids against free-radical and lipid-peroxidative damages on storage. Lipophilic free-radical quenchers, such as alpha-tocopherol and water-soluble iron-specific chelators, such as ferrioxamine, are suitable.

As used herein, a "surfactant" is a surface active agent that modifies interfacial tension of water. Typically, surfactants have one lipophilic and one hydrophilic group or region in the molecule. Broadly, the group includes soaps, detergents, emulsifiers, dispersing and wetting agents, and several groups of antiseptics. More specifically, surfactants include stearyltriethanolamine, sodium lauryl sulfate, sodium taurocholate, laurylaminopropionic acid, lecithin, benzalkonium chloride, benzethonium chloride and glycerin monostearate; and hydrophilic polymers such as polyvinyl alcohol, polyvinylpyrrolidone, polyethyleneglycol (PEG), carboxymethylcellulose sodium, methylcellulose, hydroxymethylcellulose, hydroxyethylcellulose and hydroxypropylcellulose or alkyl glycosides. In some embodiments, a surfactant is a non-ionic surfactant (e.g., an alkyl glycoside surfactant). In some embodiments, a surfactant is an ionic surfactant.

As used herein, "alkyl glycoside" refers to any sugar joined by a linkage to any hydrophobic alkyl, as is known in the art. The hydrophobic alkyl can be chosen of any desired size, depending on the hydrophobicity desired and the hydrophilicity of the saccharide moiety. In one aspect, the range of alkyl chains is from 1 to 30 carbon atoms; or from 6 to 16 carbon atoms.

As used herein, "saccharide" is inclusive of monosaccharides, oligosaccharides or polysaccharides in straight chain or ring forms. Oligosaccharides are saccharides having two or more monosaccharide residues. Some examples of the many possible saccharides suitable for use in functionalized form include glucose, galactose, maltose, maltotriose, maltotetraose, sucrose, trehalose or the like.

As used herein, "sucrose esters" are sucrose esters of fatty acids. Sucrose esters can take many forms because of the eight hydroxyl groups in sucrose available for reaction and the many fatty acid groups, from acetate on up to larger, more bulky fats that can be reacted with sucrose. This flexibility means that many products and functionalities can be tailored, based on the fatty acid moiety used. Sucrose esters have food and non-food uses, especially as surfactants and emulsifiers, with growing applications in pharmaceuticals, cosmetics, detergents and food additives. They are biodegradable, non-toxic and mild to the skin.

As used herein, a "suitable" alkyl glycoside means one that is nontoxic and nonionic. In some instances, a suitable alkyl glycoside reduces the immunogenicity or aggregation and increases the bioavailability of a compound when it is administered with the compound via the ocular, nasal, nasolacrimal, sublingual, buccal, inhalation routes or by injection routes such as the subcutaneous, intramuscular, or intravenous routes.

A "linker amino acid" is any natural or unnatural amino acid that comprises a reactive functional group (de Graaf, A. J., et al. (2009) Bioconjug Chem 20: 1281-1295) that is used for covalent linkage with a functionalized surfactant. By way of example, in some embodiments, a linker amino acid is Lys, or Orn having a reactive functional group —$NH_2$; or Cys, having a reactive functional group —SH; or Asp or Glu, having a reactive functional group —C(═O)—OH. By way of example, in some other embodiments, a linker amino acid is any amino acid having a reactive functional group such as —OH, —$N_3$, haloacetyl or an acetylenic group that is used for formation of a covalent linkage with a suitably functionalized surfactant.

As used herein, a "functionalized surfactant" is a surfactant comprising a reactive group suitable for covalent linkage with a linker amino acid. By way of example, in some embodiments, a functionalized surfactant comprises a carboxylic acid group (e.g., at the 6-position of a monosaccharide) as the reactive group suitable for covalent linkage with a linker amino acid. By way of example, in some embodiments, a functionalized surfactant comprises a —$NH_2$ group, a —$N_3$ group, an acetylenic group, a haloacetyl group, a —O—$NH_2$ group, or a —($CH_2$-)m-maleimide group, e.g., at the 6-position of a monosaccharide (as shown in Scheme 6), that allows for covalent linkage with a suitable linker amino acid. In some embodiments, a functionalized surfactant is a compound of Formula II as described herein. Optionally, in some specific embodiments, a functionalized surfactant comprises a covalently attached linker amino acid; the surfactant-modified peptide is then formed by sequential addition of one or more amino acids to the linker amino acid.

As used herein, the term "peptide" is any peptide comprising two or more amino acids. The term peptide includes polypeptides, short peptides (e.g., peptides comprising between 2-14 amino acids), medium length peptides (15-50) or long chain peptides (e.g., proteins). The terms peptide, polypeptide, medium length peptide and protein may be used interchangeably herein. As used herein, the term "peptide" is interpreted to mean a polymer composed of amino acid residues, related naturally occurring structural variants, and synthetic non-naturally occurring analogs thereof linked via peptide bonds, related naturally occurring structural variants, and synthetic non-naturally occurring analogs thereof. Synthetic peptides can be synthesized, for example, using an automated peptide synthesizer.

Peptides may contain amino acids other than the 20 gene encoded amino acids. “Peptide(s)” include those modified either by natural processes, such as processing and other post-translational modifications, but also by chemical modification techniques. Such modifications are well described in basic texts and in more detailed monographs, and are well-known to those of skill in the art. It will be appreciated that in some embodiments, the same type of modification is present in the same or varying degree at several sites in a given peptide. Also, a given peptide, in some embodiments, contains more than one type of modifications. Modifications occur anywhere in a peptide, including the peptide backbone, the amino acid side-chains, and the amino or carboxyl termini.

The term peptide includes peptides or proteins that comprise natural and unnatural amino acids or analogs of natural amino acids. As used herein, peptide and/or protein “analogs” comprise non-natural amino acids based on natural amino acids, such as tyrosine analogs, which includes para-substituted tyrosines, ortho-substituted tyrosines, and meta substituted tyrosines, wherein the substituent on the tyrosine comprises an acetyl group, a benzoyl group, an amino group, a hydrazine, an hydroxyamine, a thiol group, a carboxy group, a methyl group, an isopropyl group, a $C_2$-$C_{20}$ straight chain or branched hydrocarbon, a saturated or unsaturated hydrocarbon, an O-methyl group, a polyether group, a halogen, a nitro group, or the like. Examples of Tyr analogs include 2,4-dimethyl-tyrosine (Dmt), 2,4-diethyl-tyrosine, O-4-allyl-tyrosine, 4-propyl-tyrosine, Ca-methyl-tyrosine and the like. Examples of lysine analogs include ornithine (Orn), homo-lysine, Ca-methyl-lysine (CMeLys), and the like. Examples of phenylalanine analogs include, but are not limited to, meta-substituted phenylalanines, wherein the substituent comprises a methoxy group, a $C_1$-$C_{20}$ alkyl group, for example a methyl group, an allyl group, an acetyl group, or the like. Specific examples include, but are not limited to, 2,4,6-trimethyl-L-phenylalanine (Tmt), O-methyl-tyrosine, 3-(2-naphthyl)alanine (Nal(2)), 3-(1-naphthyl)alanine (Nal(1)), 3-methyl-phenylalanine, 1,2,3,4-tetrahydroisoquinoline-3-carboxylic acid (Tic), fluorinated phenylalanines, isopropyl-phenylalanine, p-azidophenylalanine, p-acyl-phenylalanine, p-benzoyl-phenylalanine, p-iodo-phenylalanine, p-bromophenylalanine, p-amino-phenylalanine, and isopropyl-phenylalanine, and the like. Other nonstandard or unnatural amino acids used in peptide analog design include and are not limited to C-alpha-disubstituted amino acids such as Aib, Cα-diethylglycine (Deg), aminocyclopentane-1-carboxylic acid (Ac5c), and the like. Such amino acids frequently lead to a restrained structure, often biased toward an alpha helical structure (Kaul, R. and Balaram, P. (1999) Bioorg Med Chem 7: 105-117). Additional examples of such unnatural amino acids useful in analog design are homo-arginine (Har), and the like. Substitution of reduced amide bonds in certain instances leads to improved protection from enzymatic destruction or alters receptor binding. By way of example, incorporation of a Tic-Phe dipeptide unit with a reduced amide bond between the residues (designated as Tic-Ψ[CH2-NH]-Ψ-Phe) reduces enzymatic degradation. Accordingly, also contemplated within the scope of embodiments described herein are surfactants covalently attached to peptides that comprise modified amino acids and/or peptide analogs described above. Certain non-natural amino acids are shown below.

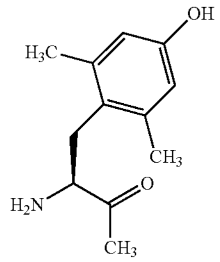

2,6-dimethyl-L-tyrosine (Dmt)

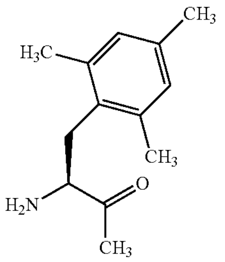

2,4,6-trimethyl-L-phenylalanine (Tmp)

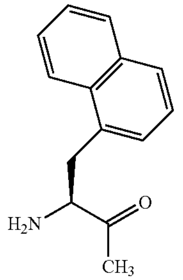

2-(1-naphthyl-L-alanine (Nal(1))

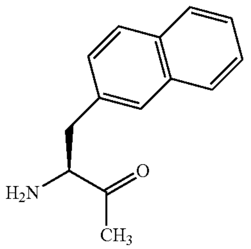

2-(2-naphthyl-L-alanine (Nal(2))

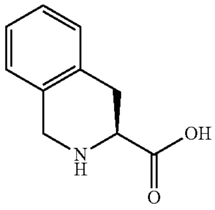

1,2,3,4-tetrahydroisoquinoline-3-carboxylic acid (Tic)

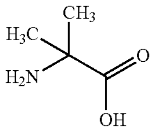

alpha-amino isobutyric acid (Aib)

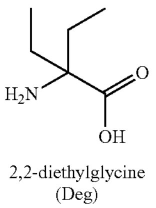

2,2-diethylglycine (Deg)

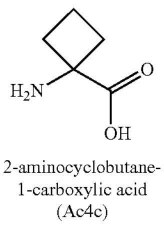

2-aminocyclobutane-1-carboxylic acid (Ac4c)

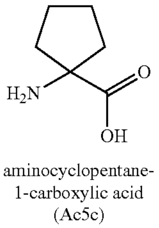

aminocyclopentane-1-carboxylic acid (Ac5c)

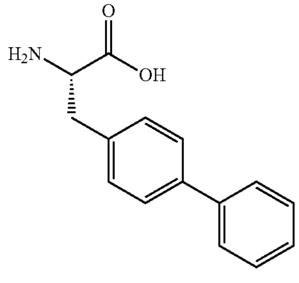

2-L-biphenyl-alanine (Bip)

-continued

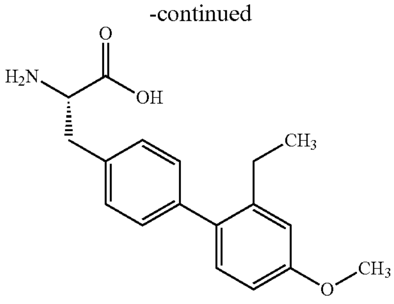

2-L-(2′-ethyl,4′-methoxy)-biphenyl-alanine (Bip2EtMeO)

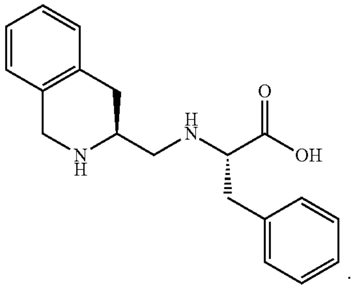

(Tic-Ψ[CH2-NH]-Ψ-Phe)

As used herein, the term "variant" is interpreted to mean a peptide that differs from a reference peptide, but retains essential properties. A typical variant of a peptide differs in amino acid sequence from another, reference peptide. Generally, differences are limited so that the sequences of the reference peptide and the variant are closely similar overall and, in many regions, identical. A variant and reference peptide may differ in amino acid sequence by one or more substitutions, additions, deletions in any combination. A substituted or inserted amino acid residue may or may not be one encoded by the genetic code. Non-naturally occurring variants of peptides may be made by mutagenesis techniques, by direct synthesis, and by other suitable recombinant methods.

Methods

Provided herein, in some embodiments are methods for prevention and/or treatment of conditions associated with decreases in insulin sensitivity comprising administration of a therapeutically effective amount of a surfactant-modified peptide and/or protein product described herein (e.g., a peptide product of Formula I-A, III-A, or III-B) to individuals in need thereof. In some embodiments, the conditions characterized by decreases in insulin sensitivity include, and are not limited to, the metabolic syndrome, obesity-related insulin resistance, hypertension, systemic inflammation associated with high C reactive protein, diabetes, or the like.

Also provided herein are methods for treatment of insulin resistance comprising administration of a therapeutically effective amount of a surfactant-modified peptide and/or protein product described herein (e.g., a peptide product of Formula I-A, III-A, or III-B) to individuals in need thereof. In some embodiments, the insulin resistance is associated with the metabolic syndrome (Syndrome X) and/or diabetes.

Further provided herein are methods for stimulating resensitization of the body to insulin comprising administration of a therapeutically effective amount of a surfactant-modified peptide and/or protein product described herein (e.g. a peptide product of Formula I-A, III-A, or III-B) to individuals in need thereof.

In yet further embodiments, provided herein are methods for increasing insulin sensitivity through weight loss, comprising administration of a therapeutically effective amount of a surfactant-modified peptide and/or protein product described herein (e.g. a peptide product of Formula I-A, III-A, or III-B and in Table 1 of FIG. 1, Table 2 of FIG. 2, and Table 3 of FIG. 3) to individuals in need thereof.

Also provided herein are methods of treating diabetes or prediabetes comprising administering to a subject in need thereof a therapeutically effective amount of a peptide product described above and herein and in Table 1 of FIG. 1, Table 2 of FIG. 2, and Table 3 of FIG. 3 to an individual in need thereof.

Provided herein are methods for treating or delaying the progression or onset of conditions selected from diabetes, diabetic retinopathy, diabetic neuropathy, diabetic nephropathy, insulin resistance, hyperglycemia, hyperinsulinemia, metabolic syndrome, diabetic complications, elevated blood levels of free fatty acids or glycerol, hyperlipidemia, obesity, hypertriglyceridemia, atherosclerosis, acute cardiovascular syndrome, infarction, ischemic reperfusion a hypertension, comprising administering a therapeutically effective amount of a peptide product described herein and in Table 1 of FIG. 1, Table 2 of FIG. 2, and Table 3 of FIG. 3 to an individual in need thereof. In an additional embodiment, provided herein are methods for treating delays in wound healing comprising administering a therapeutically effective amount of a peptide product described herein and in Table 1 of FIG. 1, Table 2 of FIG. 2, and Table 3 of FIG. 3 to an individual in need thereof.

In one embodiment said condition to be treated is diabetes. In one embodiment said condition to be treated is insulin resistance. In one embodiment said condition to be treated is the metabolic syndrome. In one embodiment said effective amount of said peptide is from about 0.1 μg/kg/day to about 100.0 μg/kg/day.

In one embodiment the method of administration is parenteral. In one embodiment the method of administration is per oral. In one embodiment the method of administration is subcutaneous. In one embodiment the method of administration is nasal insufflation.

Further provided herein is a method of reducing weight gain or inducing weight loss comprising administering a therapeutically effective amount of a peptide product described herein and in Table 1 of FIG. 1, Table 2 of FIG. 2, and Table 3 of FIG. 3 to an individual in need thereof. In some embodiments, the weight gain is associated with metabolic syndrome.

Provided herein is a method of treating hypoglycemia comprising administering a therapeutically effective amount of a peptide product described herein and in Table 1 of FIG. 1, Table 2 of FIG. 2, and Table 3 of FIG. 3 to an individual in need thereof.

Also provided herein are methods for treatment of diabetes comprising administering a therapeutically effective amount of a peptide product described herein and in Table 1 of FIG. 1, Table 2 of FIG. 2, and Table 3 of FIG. 3 to an individual in need thereof and at least one additional therapeutic agent; wherein said therapeutic agent is selected from an antidiabetic agent, an anti-obesity agent, a satiety agent, an anti-inflammatory agent, an anti-hypertensive agent, an anti-atherosclerotic agent and a lipid-lowering agent.

In some embodiments of the methods described above, the peptide and/or protein that is covalently attached to a surfactant is a glucagon or GLP-1 peptide, or an analog thereof. In some embodiments, the surfactant-modified peptide and/or protein (e.g., a peptide product of Formula I-A, III-A, or III-B) is administered prophylactically and delays occurrence of any condition associated with insulin resistance, including and not limited to the metabolic syndrome, hypertension, diabetes, type 2 diabetes, gestational diabetes, hyperlipidemia, atherosclerosis, systemic inflammation or the like. In some embodiments, the surfactant-modified peptide and/or protein (e.g., a peptide product of Formula I-A, III-A, or III-B) is administered therapeutically and delays progression of any condition associated with the metabolic syndrome, hypertension, diabetes, type 2 diabetes, gestational diabetes, hyperlipidemia, atherosclerosis, systemic inflammation or the like. In some embodiments, the surfactant-modified peptide and/or protein (e.g., a peptide product of Formula I-A, III-A, or III-B) is administered prophylactically and/or therapeutically and delays progression of insulin resistance to diabetes. In some embodiments, the surfactant-modified peptide and/or protein (e.g., a peptide product of Formula I-A, III-A, or III-B) is administered prophylactically and/or therapeutically and reduces or halts further loss of insulin resistance, thereby stabilizing disease.

In some embodiments, the surfactant-modified peptide and/or protein (e.g., a peptide product of Formula I-A, III-A, or III-B) is administered parenterally. In some embodiments, the surfactant-modified peptide and/or protein (e.g., a peptide product of Formula I-A, III-A, or III-B) is administered subcutaneously. In some embodiments, the surfactant-modified peptide and/or protein (e.g., a peptide product of Formula I-A, III-A, or III-B) is administered by nasal insufflation.

In some embodiments of the methods described above, the surfactant-modified peptide and/or protein (e.g., a peptide product of Formula I-A, III-A, or III-B) has a longer duration of action compared to a pharmaceutical comprising currently known therapeutics (e.g., exenatide, metformin or the like).

Combination Therapy

In some embodiments of the methods described above, the surfactant-modified peptide and/or protein (e.g., a peptide product of Formula I-A, III-A, or III-B) is administered in combination with other methods of treatment of the metabolic syndrome selected from the group comprising an antidiabetic agent, an anti-obesity agent, an anti-hypertensive agent, an anti-atherosclerotic agent and a lipid-lowering agent. By way of example, efficacious antidiabetic agents suitable for administration in combination with a surfactant-modified peptide and/or protein product described herein include a biguanide, a sulfonylurea, a glucosidase inhibitor a PPAR γ agonist, a PPAR α/γ dual agonist, an aP2 inhibitor, a DPP4 inhibitor, an insulin sensitizer, a GLP-1 analog, insulin and a meglitinide. Additional examples include metformin, glyburide, glimepiride, glipyride, glipizide, chlorpropamide, gliclazide, acarbose, miglitol, pioglitazone, troglitazone, rosiglitazone, muraglitazar, insulin, G1-262570, isaglitazone, JTT-501, NN-2344, L895 645, YM-440, R-119702, A19677, repaglinide, nateglinide, KAD 1129, AR-HO 39242, GW-40 I 5 44, KRP2 I 7, AC2993, LY3 I 5902, NVP-DPP-728A and saxagliptin.

In some embodiments of the methods described above, the surfactant-modified peptide and/or protein (e.g., a peptide product of Formula I-A, III-A, or III-B) is administered in combination with other methods of treatment of the metabolic syndrome selected from the group of efficacious anti-obesity agents. By way of example, efficacious anti-obesity agents suitable for administration with the peptide products described herein include beta 3 adrenergic agonist, a lipase inhibitor, a serotonin (and dopamine) reuptake inhibitor, a thyroid receptor beta compound, a CB-1 antagonist, a NPY—Y2 and a NPY—Y4 receptor agonist and an anorectic agent. Specific members of these classes comprise orlistat, AfL-962, A19671, L750355, CP331648, sibutramine, topiramate, axokine, dexamphetamine, phentermine, phenylpropanolamine, rimonabant (SR1 4I7164), and mazindol.

In some embodiments of the methods described above, the surfactant-modified peptide and/or protein (e.g., a peptide product of Formula I-A, III-A, or III-B) is administered in combination with other methods of treatment of the metabolic syndrome selected from the group of efficacious lipid-lowering agents. By way of example, efficacious lipid-lowering agents suitable for administration with the peptide products described herein include agents selected from the group consisting of an MTP inhibitor, cholesterol ester transfer protein, an HMG CoA reductase inhibitor, a squalene synthetase inhibitor, a fibric acid derivative, an upregulator of LDL receptor activity, a lipoxygenase inhibitor, and an ACAT inhibitor. Specific examples from these classes comprise pravastatin, lovastatin, simvastatin, atorvastatin, cerivastatin, fluvastatin, nisvastatin, visastatin, fenofibrate, gemfibrozil, clofibrate, avasimibe, TS-962, MD-700, CP-52941 4, and LY295 427.

In some embodiments of the methods described above, the surfactant-modified peptide and/or protein (e.g., a peptide product of Formula I-A, III-A, or III-B) is administered in combination with peptide hormones, and analogs thereof, that are known to exhibit pro-satiety effects in animal models and in man. Contemplated within the scope of embodiments presented herein is a combination of the peptide products described herein and long-acting satiety agents for treatment of obesity. Examples of such peptide satiety agents include GLP-1, pancreatic polypeptide (PP), cholecystokinin (CCK), peptide YY (PYY), amylin, calcitonin, OXM, neuropeptide Y (NPY), and analogs thereof (Bloom, S. R., et al. (2008) Mol Interv 8: 82-98; Field, B. C., et al. (2009) Br J Clin Pharmacol 68: 830-843).

Also contemplated within the scope of embodiments presented herein are methods for treatment of obesity comprising administration of peptide products described herein in combination with peptide hormones including and not limited to leptin, ghrelin and CART (cocaine- and amphetamine-regulated transcript) analogs and antagonists.

Additional peptide products in the body are associated with fat cells or the obese state (adipokines) and are known to have proinflammatory effects (Gonzalez-Periz, A. and Claria, J. (2010) ScientificWorldJournal 10: 832-856). Such agents will have additional favorable actions when used in combination with the peptide products described herein. Examples of agents that offer a beneficial effect when used in combination with the peptide products described herein include analogs and antagonists of adiponectin, chemerin, visfatin, nesfatin, omentin, resistin, TNFalpha, IL-6 and obestatin.

Intermediates

In one embodiment the provided herein are intermediates and/or reagents comprising a surfactant moiety and a reactive functional group capable of forming a bond with a reactive functional group on a natural or unnatural amino acid. These intermediates and/or reagents allow for improvement in the bioavailability and pharmaceutical, pharmacokinetic and/or pharmacodynamic behavior of peptides and/or proteins of use in human and animal disease. Covalent attachment of such intermediates and/or reagents via functional group on a side chain of an amino acid, for example on an epsilon-amino function of Lys, the sulfhydryl of Cys, or at the amino or carboxy terminus of the peptide and/or protein target allows for synthesis of the peptide products described herein. In specific embodiments, non-ionic surfactant moieties are mono or disaccharides with an O-alkyl glycosidic substitution, said glycosidic linkage being of the alpha or beta configuration. In specific embodiments, O-alkyl chains are from $C_1$-$C_{20}$ or from $C_6$-$C_{16}$ alkyl chains.

In another embodiment provided herein are intermediates and/or reagents comprising a non-ionic surfactant moiety with certain alkyl glycosidic linkage that mimic O-alkyl glycosidic linkages and a reactive functional group capable of forming a bond with a reactive functional group on a natural or unnatural amino acid. Such intermediates and/or reagents contain S-linked alkyl chains or N-linked alkyl chains and have altered chemical and/or enzymatic stability compared to the O-linked alkyl glycoside-linked products.

In some embodiments, an intermediate and/or reagent provided herein is a compound wherein the hydrophilic group is a modified glucose, galactose, maltose, glucuronic acid, diglucuronic acid or the like. In some embodiments, the hydrophilic group is glucose, maltose, glucuronic acid, or diglucuronic acid and the hydrophobic group is a $C_1$-$C_{20}$ alkyl chain or an aralkyl chain. In some embodiments the glycosidic linkage to the hydrophobic group is of an alpha configuration and in some the linkage is beta at the anomeric center on the saccharide.

In some embodiments, the hydrophilic group is glucose, maltose, glucuronic acid, or diglucuronic acid and the hydrophobic group is a $C_1$-$C_{20}$ alkyl or aralkyl chain.

In some embodiments, an intermediate and/or reagent provided herein comprises a surfactant containing a reactive functional group that is a carboxylic acid group, an amino group, an azide, an aldehyde, a maleimide, a sulfhydryl, a hydroxylamino group, an alkyne or the like.

In some embodiments, the intermediate and/or reagent is an O-linked alkyl glycoside with one of the hydroxyl functions modified to be a carboxylic acid or amino functional group. In some embodiments, the reagent is a 1-O-alkyl glucuronic acid of alpha or beta configuration and the alkyl chain is from $C_1$ to $C_{20}$ in length. In some of such embodiments, the alkyl group is from $C_6$ to $C_{16}$ in length.

In some embodiments, the reagent comprises a 1-O-alkyl diglucuronic acid of alpha or beta configuration and the alkyl chain is from $C_1$ to $C_{20}$ in length. In some of such embodiments, the alkyl group is from $C_6$ to $C_{16}$ in length.

In some embodiments, the reagent is an S-linked alkyl glycoside of alpha or beta configuration with one of the hydroxyl functions modified to be a carboxylic acid or amino functional group.

In some embodiments, the reagent is an N-linked alkyl glycoside of alpha or beta configuration with one of the hydroxyl functions modified to be a carboxylic acid or amino functional group.

In yet another embodiment the provided herein are peptide and/or protein products containing a covalently linked alkyl glycoside with properties acceptable for use in human and animal disease. Scheme 1 lists exemplary non-ionic surfactants that can be modified to yield the reagents and/or intermediates that are useful for synthesis of surfactant-modified peptide products described herein.

Scheme 1. Examples of commercially-available non-ionic surfactants of the alkyl glycoside class

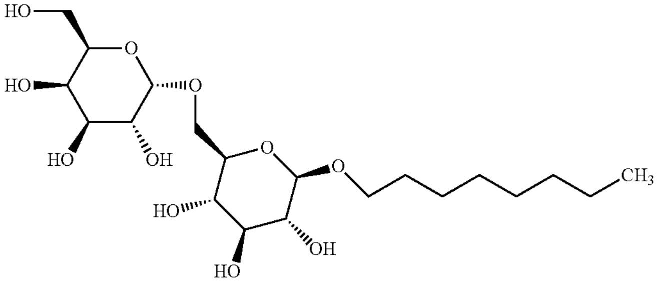

1-Octyl beta-D-melibioside

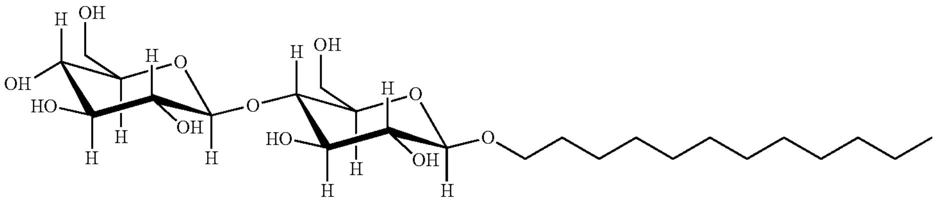

Dodecylmaltoside

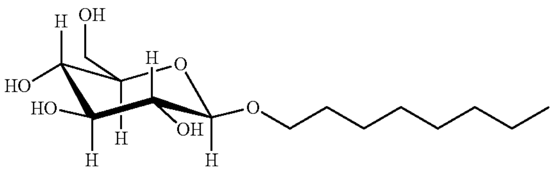

Octylglucoside

In some embodiments, the covalently modified peptides and/or proteins described herein incorporate a surfactant moiety into the peptide structure. In specific embodiments, the covalently modified peptides and/or proteins described herein incorporate a non-ionic surfactant of the alkyl, alkoxyaryl, or aralkyl glycoside class. Alkyl glycosides are important commodities and are widely used in the food, service and cleaning industries. Thus their production on commercially significant scale has been the subject of extensive study. Both enzymatic and chemical processes are available for their production at very low cost (Park, D. W., et al. (2000) Biotechnology Letters 22: 951-956). These alkyl glycosides can be modified further to generate the intermediates for the synthesis of the covalently modified peptides and/or proteins described herein. Thus it is known that 1-dodecyl beta-D-glucoside is preferentially oxidized on the 6-position to yield the corresponding glucuronic acid analog in high yield when using the unprotected material and platinum black catalyst in the presence of oxygen (van Bekkum, H. (1990) Carbohydrates as Organic Raw Materials 289-310). Additional chemoselective methods for oxidation of the primary alcohol at the 6 position of alkyl glucosides are available. For example, use of catalytic amounts of 2,2,6,6-tetramethyl-1-piperidinyloxyl (TEMPO) with stoichiometric amounts of the organic oxidant [bis(acetoxy)iodo]benzene (BAIB) (De Mico, A., et al. (1997) J Org Chem 1997: 6974-6977) gave outstanding yields of nucleoside-5'-carboxylic acids (Epp, J. B. and Widlanski, T. S. (1999) J Org Chem 64: 293-295) by oxidation of the primary hydroxyl. This oxidation is chemoselective for the primary hydroxyl even when the other, secondary hydroxyls are unprotected (Codee, J. D., et al. (2005) J Am Chem Soc 127: 3767-3773). In a similar manner, 1-dodecyl β-D-glucopyranoside, 1-tetradecyl β-D-glucopyranoside, 1-hexadecyl β-D-glucopyranoside, 1-octadecyl β-D-glucopyranoside and 1-eicosyl β-D-glucopyranoside were oxidized to the corresponding uronic acids (1-dodecyl β-D-glucuronic acid, 1-tetradecyl β-D-glucuronic acid, 1-hexadecyl β-D-glucuronic acid, 1-octadecyl β-D-glucuronic acid, 1-eicosyl β-D-glucuronic acid) by oxidation with TEMPO using KBr and sodium hypochlorite as stoichiometric oxidant (Milkereit, G., et al. (2004) Chem Phys Lipids 127: 47-63) in water. A mild oxidation procedure using (diacetoxyiodo)benzene (DAIB aka BAIB) is given in the Examples. Certain of these glucuronic acid intermediates are commercially available (for example octyl b-D-glucuronic acid; Carbosynth, MO 07928) and, as indicated, a broad range are subject to preparation by routine methods (Schamann, M. and Schafer, H. J. (2003) Eur J Org Chem 351-358; Van den Bos, L. J., et al. (2007) Eur J Org Chem 3963-3976) or, upon request, from commercial sources. Scheme 2 illustrates, as examples, certain functionalized surfactant intermediates comprising a —COOH group as a reactive functional group that are used to prepare the intermediates and/or reagents described herein.

Scheme 2. Examples of alkyl diglucuronic and glucuronic acid class reagents.

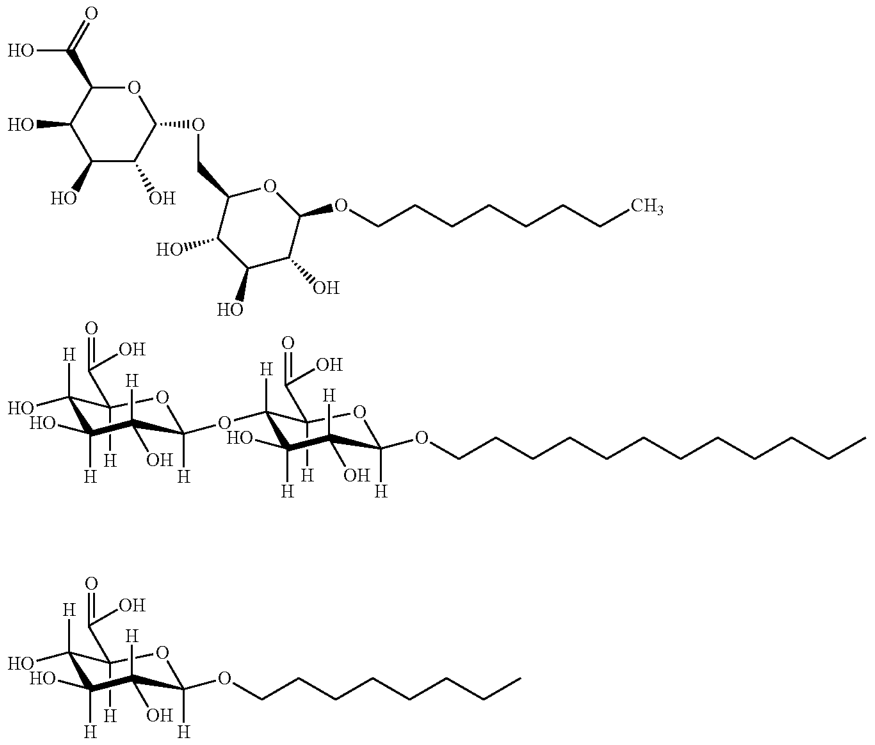

Similarly, aralkyl glycosides (including alkoxyaryl) can form the basis for closely related nonionic surfactant reagents. For example, 4-alkoxyphenyl β-D-glucopyranosides are readily synthesized by the reaction of 4-alkyloxyphenols with penta-O-acetyl β-D-glucose in the presence of boron trifluoride etherate. Subsequent deacetylation using trimethylamine in methanol/water and selective oxidation as described above and in the examples, yields the alkoxyaryl glucuronic acid reagents suitable for forming the reagents and peptides described herein ((Smits, E., et al. (1996) J Chem Soc, Perkin Trans I 2873-2877; Smits, E., et al. (1997) Liquid Crystals 23: 481-488).

Scheme 3. Illustrative members of aralkyl or alkoxyaryl surfactant moiety.

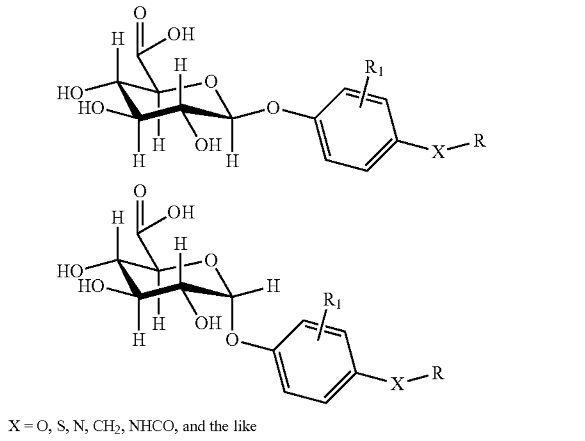

The glucuronic acid class of intermediate is readily activated by standard coupling agents for linkage to an amino acid side chain, e.g. that of Lys. Thus Fmoc-Lys-O-TMS (trimethylsilyl=TMS) can be reacted with octyl beta-D-glucuronic acid in the presence of a coupling agent and the O-TMS protecting group can then be hydrolyzed on aqueous workup to yield Fmoc-Lys(1-octyl beta-D-glucuronamide) as shown in Scheme 4. This reagent can be used for incorporation into the solid phase synthesis of peptides, using standard coupling protocols, when it is desired to incorporate the surfactant moiety near the N-terminal region of the molecule. The secondary hydroxyl groups can be left unprotected, due to the very much higher reactivity of the Lys amino functional group or they can be protected by peracetylation. If an acetyl protected form is used, the acetyl protecting groups can be removed in high yield by treatment with either MeOH/NaOMe or by $MeOH/Et_3N$. Scheme 4 illustrates preparation of the reagents described herein.

Scheme 4. Example of a preparation of a reagent.

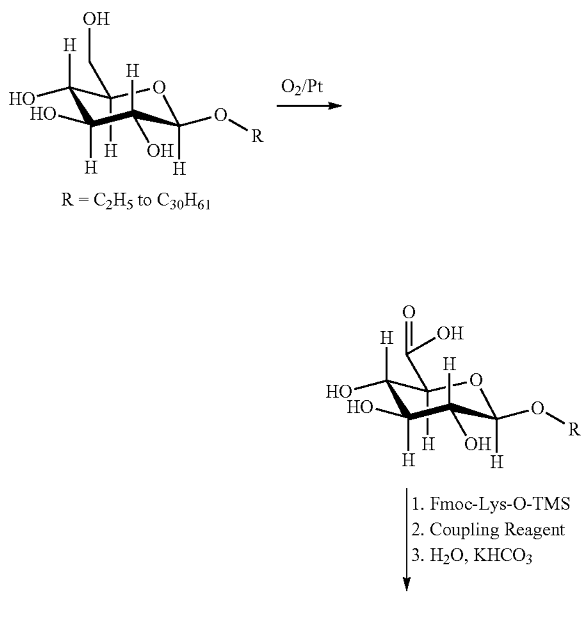

-continued

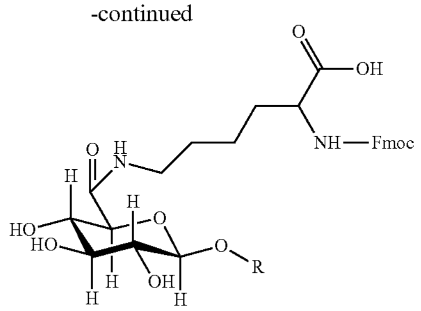

In some embodiments, reagents and/or intermediates for the preparation of the biologically active peptide products described herein comprise a family of surfactant-modified linker amino acids for incorporation into synthetic peptide products. Thus in one embodiment, peptide products described herein are synthesized in a linear fashion wherein a functionalized surfactant is attached to a reversibly-protected linker amino acid via functional group on a side chain of a linker amino acid (e.g., an amino group of a lysine residue) to yield a proprietary reagent (as shown in Scheme 4) which can be incorporated into the growing peptide chain and then the remaining peptide is synthesized by attachment of further amino acids to the cysteine residue. Protecting group suitable for synthesis of modified peptides and/or protein described herein are described in, for example, T. W. Green, P. G. M. Wuts, Protective Groups in Organic Synthesis, Wiley-Interscience, New York, 1999, 503-507, 736-739, which disclosure is incorporated herein by reference.

In another embodiment, peptide products described herein are synthesized by covalent attachment of a functionalized surfactant to a full-length peptide via suitable functional group on a linker amino acid that is in the peptide chain.

Alternatively a functionalized surfactant can be added to a linker amino acid side chain which has been deprotected during the course of the solid phase synthesis of the peptide. As an example, an alkyl glucuronyl group can be added directly to a linker amino acid side chain (e.g., a deprotected Lys side chain) during the solid phase synthesis of the peptide. For example, use of Fmoc-Lys(Alloc)-OH as a subunit provides orthogonal protection that can be removed while the peptide is still on the resin. Thus deprotection of the Lys side chain using Pd/thiobarbital, Pd/1,3-dimethyl barbituric acid (DMBA) or other Alloc deprotection recipe allows exposure of the amino group for coupling with the acyl protected or unprotected 1-octyl beta-D-glucuronic acid unit or for side chain lactam formation. Final deprotection with a low % $CF_3CO_2H$ (TFA) cleavage cocktail will then deliver the desired product. Although the glycosidic linkage is labile to strong acid, the experience here and by others is that it is relatively stable to low % TFA cleavage conditions. Alternatively, acyl protection (e.g. acetyl, Ac; benzoyl, Bz) or trialkylsilyl protection on the saccharide OH functional groups may be used to provide increased protection to the glycosidic linkage. Subsequent deprotection by base ($NH_2NH_2$/MeOH; $NH_3$/MeOH, NaOMe/MeOH) yields the desired deprotected product. Scheme 4 illustrates reagents described herein. Scheme 5 illustrates a non-limiting example of a peptide intermediate described herein. Although this example illustrates a peptide with the surfactant linkage at the N-terminus of the peptide, the methods described herein are suitable for synthesis of peptide intermediates having the linkage to a surfactant in the middle region, the C-terminal region or any position within the peptide.

Scheme 5. Illustrative example of a peptide intermediate.

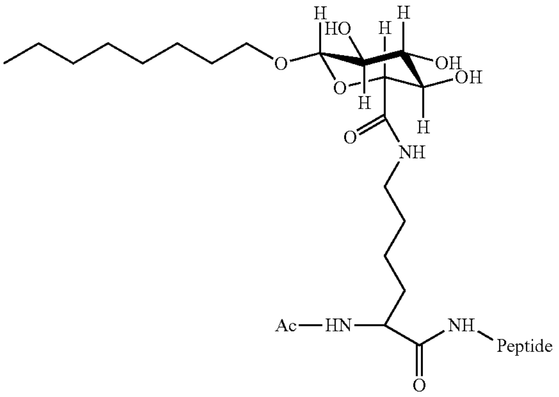

Additional reagents are generated by modification of the 6-position functional group to give varied means of linkage to amino acid side chain functional groups, as shown below in Scheme 6. Thus amino substitution can be used for linkage to Asp or Glu side chains. Azido or alkyne substitution can be used for linkage to unnatural amino acids containing the complementary acceptor for Huisgen 3+2 cycloaddition (Gauthier, M. A. and Klok, H. A. (2008) Chem Commun (Camb) 2591-2611). Aminoxy or aldehyde functional groups can be used to link to aldehyde (i.e. oxime linkage) or to amino functions (i.e. reductive alkylation), respectively. The maleimide or —NH—(C═O)—$CH_2$—Br functional group can bind chemoselectively with a Cys or other SH functional group. These types of linkage strategies are advantageous when used in conjunction with the reagents described herein. Interconversion of functional groups is widely practiced in organic synthesis and comprehensive lists of multiple routes to each of the functional group modifications listed herein are available (Larock, R. C. (1999)) "Comprehensive Organic Transformations", VCH Publishers, New York.

Thus, for example, the primary hydroxyl on position 6 of octyl 1-β-D-glucoside is converted to the azide by activation and displacement with an azide anion, reactions such as reactions used in carbohydrate chemistry (e.g. by tosylation followed by $NaN_3$). The corresponding azide is reduced to the amino function by reduction with thiolacetic acid in pyridine (Elofsson, M., et al. (1997) Tetrahedron 53: 369-390) or by similar methods of amino group generation (Stangier, P., et al. (1994) Liquid Crystals 17: 589-595). Approaches to the acetylene, aminoxy, and aldehyde moieties are best carried out on the triacetoxy form, available from the commercially available glucoside by treatment with $Ac_2O$, followed by mild hydrolysis of the primary amine. This 6-hydroxy form can be selectively oxidized to the aldehyde, or activated as a tosylate or triflate and displaced by $NH_2OH$ or by sodium acetylide. The maleimide linkage can be through a carbon linkage as shown or, preferably though an O or amide linkage, again by displacement of the activated hydroxyl or coupling of the glucuronic acid derivative to an amino linked maleimide reagent, well known in the art. Additional functional group interconversions are well known to those of average skill in the art of medicinal chemistry and are within the scope of the embodiments described herein.

Also contemplated within the scope of synthetic methods described herein are surfactants wherein the saccharide and hydrophobic chain are covalently attached via an alpha glycosidic linkage. Synthetic routes to predominantly α-linked glycosides are well known in the art and typically originate with the peracetyl sugar and use acidic catalysis (e.g. $SnCl_4$, $BF_3$ or HCl) to effect the α-glycosylation (Cudic, M. and Burstein, G. D. (2008) Methods Mol Biol 494: 187-208; Vill, V., et al. (2000) Chem Phys Lipids 104: 75-91, incorporated herein by reference for such disclosure). Similar synthetic routes exist for disaccharide glycosides (von Minden, H. M., et al. (2000) Chem Phys Lipids 106: 157-179, incorporated herein by reference for such disclosure). Functional group interconversions then proceed as above to lead to the 6-carboxylic acid, et al. for generation of the corresponding α-linked reagents.

Scheme 6 lists certain compounds and reagents useful in the synthesis of the covalently modified peptides and/or proteins described herein. Standard nomenclature using single letter abbreviations for amino acids are used.

Scheme 6. Additional reagent examples.

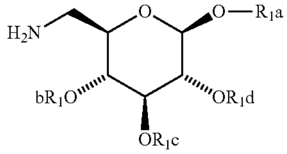

R1a = C1-C30
R1b-d = H, Ac, Bz, Bn, OMe

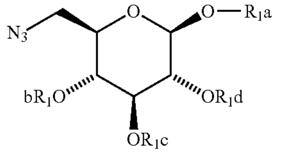

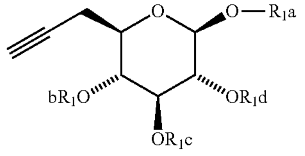

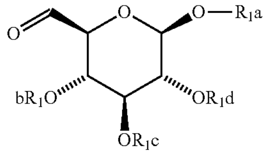

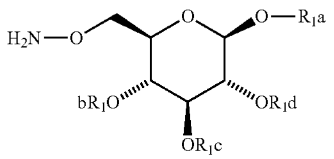

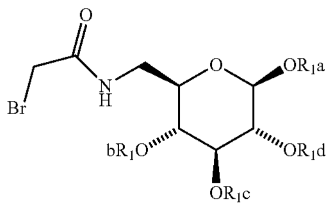

-continued

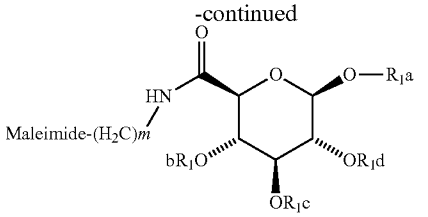

Many alkyl glycosides can be synthesized by known procedures, as described, e.g., in (Rosevear, P., et al. (1980) Biochemistry 19: 4108-4115, Li, Y. T., et al. (1991) J Biol Chem 266: 10723-10726) or Koeltzow and Urfer, J. Am. Oil Chem. Soc., 61:1651-1655 (1984), U.S. Pat. Nos. 3,219,656 and 3,839,318 or enzymatically, as described, e.g., in (Li, Y. T., et al. (1991) J Biol Chem 266: 10723-10726, Gopalan, V., et al. (1992) J Biol Chem 267: 9629-9638). O-alkyl linkages to natural amino acids such as Ser can be carried out on the Fmoc-Ser-OH using peracetylglucose to yield Nα-Fmoc-4-O-(2,3,4,6-tetra-O-acetyl-β-D-glucopyranosyl)-L-serine. This material is selectively deprotected at the primary carbon atom (position 6) and selectively oxidized using TEMPO/BAIB as described above to yield the corresponding 6-carboxyl function which may be coupled to lipophilic amines to generate a new class of nonionic surfactant and reagents (Scheme 7).

Scheme 7. Alternative example of nonionic surfactant reagent.

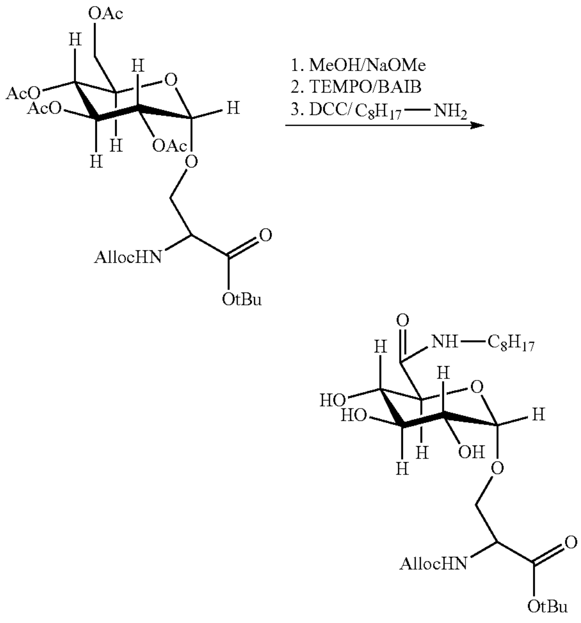

The linkage between the hydrophobic alkyl and the hydrophilic saccharide can include, among other possibilities, a glycosidic, thioglycosidic, amide (Carbohydrates as Organic Raw Materials, F. W. Lichtenthaler ed., VCH Publishers, New York, 1991), ureido (Austrian Pat. 386,414 (1988); Chem. Abstr. 110:137536p (1989); see Gruber, H. and Greber, G., "Reactive Sucrose Derivatives" in Carbohydrates as Organic Raw Materials, pp. 95-116) or ester linkage (Sugar Esters: Preparation and Application, J. C. Colbert ed., (Noyes Data Corp., New Jersey), (1974)).

Examples from which useful alkyl glycosides can be chosen for modification to the reagents or for the formulation of the products described herein, include: alkyl glycosides, such as octyl-, nonyl-, decyl-, undecyl-, dodecyl-, tridecyl-, tetradecyl, pentadecyl-, hexadecyl-, heptadecyl-, and octadecyl-D-maltoside, -melibioside, -glucoside or -sucroside (i.e., sucrose ester) (synthesized according to Koeltzow and Urfer; Anatrace Inc., Maumee, Ohio; Calbiochem, San Diego, Calif.; Fluka Chemie, Switzerland); alkyl thiomaltosides, such as heptyl, octyl, dodecyl-, tridecyl-, and tetradecyl-β-D-thiomaltoside (synthesized according to Defaye, J. and Pederson, C., "Hydrogen Fluoride, Solvent and Reagent for Carbohydrate Conversion Technology" in Carbohydrates as Organic Raw Materials, 247-265 (F. W. Lichtenthaler, ed.) VCH Publishers, New York (1991); Ferenci, T., J. Bacteriol, 144:7-11 (1980)); alkyl thioglucosides, such as 1-dodecyl- or 1-octyl-thio α- or β-D-glucopyranoside (Anatrace, Inc., Maumee, Ohio; see Saito, S. and Tsuchiya, T. Chem. Pharm. Bull. 33:503-508 (1985)); alkyl thiosucroses (synthesized according to, for example, Binder, T. P. and Robyt, J. F., Carbohydr. Res. 140:9-20 (1985)); alkyl maltotriosides (synthesized according to Koeltzow and Urfer); long chain aliphatic carbonic acid amides of sucrose amino-alkyl ethers; (synthesized according to Austrian Patent 382,381 (1987); Chem. Abstr., 108:114719 (1988) and Gruber and Greber pp. 95-116); derivatives of palatinose and isomaltamine linked by amide linkage to an alkyl chain (synthesized according to Kunz, M., "Sucrose-based Hydrophilic Building Blocks as Intermediates for the Synthesis of Surfactants and Polymers" in Carbohydrates as Organic Raw Materials, 127-153); derivatives of isomaltamine linked by urea to an alkyl chain (synthesized according to Kunz); long chain aliphatic carbonic acid ureides of sucrose amino-alkyl ethers (synthesized according to Gruber and Greber, pp. 95-116); and long chain aliphatic carbonic acid amides of sucrose amino-alkyl ethers (synthesized according to Austrian Patent 382,381 (1987), Chem. Abstr., 108: 114719 (1988) and Gruber and Greber, pp. 95-116).

Some preferred glycosides which can be further modified to incorporate reactive functionality for linkage to the peptide include the saccharides maltose, sucrose, glucose and galactose linked by glycosidic or ester linkage to an alkyl chain of 6, 8, 10, 12, 14, or 16 carbon atoms, e.g., hexyl-, octyl-, decyl-, dodecyl-, tetradecyl-, and hexadecyl-maltoside, -melibioside, -sucroside, -glucoside and -galactoside. In the body these glycosides are degraded to non-toxic alcohol or fatty acid and an oligosaccharide or saccharide. The above examples are illustrative of the types of alkyl glycosides to be used in the methods claimed herein, however the list is not intended to be exhaustive.

Generally, these surfactants (e.g., alkyl glycosides) are optionally designed or selected to modify the biological properties of the peptide, such as to modulate bioavailability, half-life, receptor selectivity, toxicity, biodistribution, solubility, stability, e.g. thermal, hydrolytic, oxidative, resistance to enzymatic degradation, and the like, facility for purification and processing, structural properties, spectroscopic properties, chemical and/or photochemical properties, catalytic activity, redox potential, ability to react with other molecules, e.g., covalently or noncovalently, and the like.

Surfactants

The term "surfactant" comes from shortening the phrase "surface active agent". In pharmaceutical applications, surfactants are useful in liquid pharmaceutical formulations in which they serve a number of purposes, acting as emulsifiers, solubilizers, and wetting agents. Emulsifiers stabilize the aqueous solutions of lipophilic or partially lipophilic substances. Solubilizers increase the solubility of components of pharmaceutical compositions increasing the concentration which can be achieved. A wetting agent is a chemical additive which reduces the surface tension of a fluid, inducing it to spread readily on a surface to which it is applied, thus causing even "wetting" of the surface with the fluids. Wetting agents provide a means for the liquid formulation to achieve intimate contact with the mucous membrane or other surface areas with which the pharmaceutical formulation comes in contact. Thus surfactants may be useful additives for stabilization of the formulation of the peptide products described herein as well as for the modification of the properties of the peptide itself.

In specific embodiments, alkyl glycosides which are synthetically accessible, e.g., the alkyl glycosides dodecyl, tridecyl and tetradecyl maltoside, -melibioside or -glucoside as well as sucrose dodecanoate, tridecanoate, and tetradecanoate are suitable for covalent attachment to peptides as described herein. Similarly, the corresponding alkylthioglycosides are stable, synthetically accessible surfactants which are acceptable for formulation development.

A wide range of physical and surfactant properties can be achieved by appropriate modification of the hydrophobic or hydrophilic regions of the surfactant (e.g., the alkyl glycoside). For example, a study comparing the bilayer activity of dodecyl maltoside (DM) with that of dodecyl glucoside (DG) found that of DM to be more than three times higher than that of DG, despite having the same length of hydrophobic tail (Lopez, O., et al. (2002) Colloid Polym Sci 280: 352-357). In this particular instance the identity of the polar region (disaccharide vs. monosaccharide) influences surfactant behavior. In the case of a surfactant linked to a peptide, e.g. the peptide products described herein, the peptide region also may contribute hydrophobic or hydrophilic character to the overall molecule. Thus tuning of the physical and surfactant properties may be used to achieve the particular physical and pharmaceutical properties suitable for the individual peptide targets.

PEG Modification

In some embodiments, surfactant-modified peptide products described herein are further modified to incorporate one or more PEG moieties (Veronese, F. M. and Mero, A. (2008) BioDrugs 22: 315-329). In some instances, incorporation of large PEG chains prevents filtration of the peptide in the glomeruli in the kidney into the dilute urine forming there (Nestor, J. J., Jr. (2009) Current Medicinal Chemistry 16: 4399-4418, Caliceti, P. and Veronese, F. M. (2003) Adv Drug Deliv Rev 55: 1261-1277). In some embodiments, an optional PEG hydrophilic chain allows for balancing the solubility and physical properties of the peptides or proteins that have been rendered hydrophobic by the incorporation of the longer chain alkyl glycoside moiety.

PEGylation of a protein can have potentially negative effects as well. Thus PEGylation can cause a substantial loss of biological activity for some proteins and this may relate to ligands for specific classes of receptors. In such instances there may be a benefit to reversible PEGylation (Peleg-Shulman, T., et al. (2004) J Med Chem 47: 4897-4904, Greenwald, R. B., et al. (2003) Adv Drug Deliv Rev 55: 217-250, Roberts, M. J. and Harris, J. M. (1998) J Pharm Sci 87: 1440-1445).

In addition, the increased molecular mass may prevent penetration of physiological barriers other than the glomerular membrane barrier. For example, it has been suggested that high molecular weight forms of PEGylation may prevent penetration to some tissues and thereby reduce therapeutic efficacy. In addition, high molecular weight may prevent uptake across mucosal membrane barriers (nasal, buccal, vaginal, oral, rectal, lung delivery). However delayed uptake may be highly advantageous for administration of stable molecules to the lung, substantially prolonging the duration of action. The peptide and/or protein products described herein have increased transmucosal bioavailability and this will allow longer chain PEG modifications to be used in conjunction with the surfactant modification with the achievement of commercially significant bioavailability following intranasal or other transmucosal route.

In some embodiments, long chain PEG polymers, and short chain PEG polymers are suitable for modification of the proteins and peptides described herein. Administration of treatments for diabetes by inhalation is a new approach for drug delivery and the lung has a highly permeable barrier (e.g. Exubera). For this application, delayed penetration of the lung barrier, preferred forms of PEGylation are in the lower molecular weight range of $C_{10}$ to $C_{400}$ (roughly 250 to 10,000 Da). Thus while a primary route to prolongation by PEG is the achievement of an "effective molecular weight" above the glomerular filtration cut-off (greater than 68 kDa), use of shorter chains may be a route for prolongation of residence in the lung for treatment of lung diseases and other respiratory conditions. Thus PEG chains of about 500 to 3000 Da are of sufficient size to slow the entry into the peripheral circulation, but insufficient to cause them to have a very prolonged circulation time. In some embodiments, PEGylation is applied to give increased local efficacy to the lung tissue with reduced potential for systemic side effects for the covalently modified peptides and/or proteins described herein. In some of such embodiments, PEG chains in the range from about 750 to about 1500 Da are referred collectively as "PEG1K."

In addition, other polymers may be used in conjunction with the compounds of described herein in order to optimize their physical properties. For example poly(2-ethyl 2-oxazoline) conjugates have variable hydrophobicity and sufficient size to enhance duration of action (Mero, A., et al. (2008) J Control Release 125: 87-95). Linkage of such a polymer to a saccharide yields a class of surfactant suitable for use in modification of peptides and/or proteins described herein.

Polyethylene glycol chains are functionalized to allow their conjugation to reactive groups on the peptide and/or protein chain. Typical functional groups allow reaction with amino, carboxyl or sulfhydryl groups on the peptide through the corresponding carboxyl, amino or maleimido groups (and the like) on the polyethylene glycol chain. In an embodiment, PEG comprises a $C_{10}$-$C_{3000}$ chain. In another embodiment, PEG has a molecular weight above 40,000 Daltons. In yet another embodiment, PEG has a molecular weight below 10,000 Daltons. PEG as a protein modification is well known in the art and its use is described, for example, in U.S. Pat. Nos. 4,640,835; 4,496,689; 4,301,144; 4,670,417; 4,791,192; and 4,179,337.

A non-traditional type of PEG chain is modified to be amphiphilic in nature. That is it has both the hydrophilic PEG structure but is modified to contain hydrophobic regions such as fatty acid esters and other hydrophobic components. See for example (Miller, M. A., et al. (2006) Bioconjug Chem 17: 267-274); Ekwuribe, et al. U.S. Pat. No. 6,309,633; Ekwuribe, et al. U.S. Pat. No. 6,815,530; Ekwuribe, et al. U.S. Pat. No. 6,835,802). Although these amphiphilic PEG conjugates to proteins were originally developed to increase oral bioavailability they were relatively ineffective in this role. However the use of such amphiphilic PEG conjugates with amphipathic peptides will give significantly prolonged residence in the lung to extend the useful biological activity of these pharmaceuticals. The preferred PEG chains are in the molecular weight range of 500 to 3000 Da. Detailed descriptions of the methods of synthesis of these conjugates is given in the references above, the full content of which is incorporated herein.

A PEG entity itself does not have a functional group to be attached to a target molecular, such as a peptide. Therefore, to create PEG attachment, a PEG entity must be functionalized first, then a functionalized attachment is used to attach the PEG entity to a target molecule, such as a peptide (Greenwald, R. B., et al. (2003) Adv Drug Deliv Rev 55: 217-250, Veronese, F. M. and Pasut, G. (2005) Drug Discov Today 10: 1451-1458, Roberts, M. J., et al. (2002) Adv Drug Deliv Rev 54: 459-476). In one embodiment, site-specific PEGylation can be achieved through Cys substitution on a peptide molecule. The target peptide can be synthesized by solid phase synthesis, recombinant means, or other means, as described herein.

Thus in some embodiments, a peptide product described herein comprises a Lys or other reactive residue modified with an alkyl glycoside and specific PEGylation on at least one Cys residue, a Lys residue or other reactive amino acid residue elsewhere in the molecule.

In another embodiment, a Lys or other residue with a nucleophilic side chain may be used for incorporation of the PEG residue. This may be accomplished through the use of an amide or carbamate linkage to a PEG-carboxyl or PEG-carbonate chain. See for example as described (Veronese, F. M. and Pasut, G. (2005) Drug Discov Today 10: 1451-1458). An alternative approach is to modify the Lys side chain amino function through attachment of an SH containing residue, such as mercaptoacetyl, mercaptopropionyl ($CO—CH_2—CH_2—CH_2—SH$), and the like. Alternatively the PEG chain may be incorporated at the C-Terminus as an amide during the course of the synthesis. Additional methods for attaching PEG chains utilize reaction with the side chains of His and Trp. Other similar methods of modifying the peptide chain to allow attachment of a PEG chain are known in the art and are incorporated herein by reference (Roberts, M. J., et al. (2002) Adv Drug Deliv Rev 54: 459-476).

Formulations

In one embodiment, the covalently modified peptides or proteins as disclosed herein are provided in a formulation that further reduces, prevents, or lessens peptide and/or protein association or aggregation in the composition, for example, reduces peptide and/or protein self-association or self-aggregation, or reduces association or aggregation with other peptides or proteins when administered to the subject.

Self-Association at high protein concentration is problematic in therapeutic formulations. For example, self-association increases the viscosity of a concentrated monoclonal antibody in aqueous solution. Concentrated insulin preparations are inactivated by self aggregation. These self associating protein interactions, particularly at high protein concentration, reduce, modulate or obliterate biological activity of many therapeutics (Clodfelter, D. K., et al. (1998) Pharm Res 15: 254-262). Therapeutic proteins formulated at high concentrations for delivery by injection or other means can be physically unstable or become insoluble as a result of these protein interactions.

A significant challenge in the preparation of peptide and protein formulations is to develop manufacturable and stable dosage forms. Physical stability properties, critical for processing and handling, are often poorly characterized and difficult to predict. A variety of physical instability phenomena are encountered such as association, aggregation, crystallization and precipitation, as determined by protein interaction and solubility properties. This results in significant manufacturing, stability, analytical, and delivery challenges. Development of formulations for peptide and protein drugs requiring high dosing (on the order of mg/kg) are required in many clinical situations. For example, using the SC route, approximately <1.5 mL is the allowable administration volume. This may require >100 mg/mL protein concentrations to achieve adequate dosing. Similar considerations exist in developing a high-concentration lyophilized formulation for monoclonal antibodies. In general, higher protein concentrations permit smaller injection volume to be used which is very important for patient comfort, convenience, and compliance. The surfactant-modified compounds described herein are designed to minimize such aggregation events and may be further facilitated through the use of small amounts of surfactants as herein described.

Because injection is an uncomfortable mode of administration for many people, other means of administering peptide therapeutics have been sought. Certain peptide and protein therapeutics may be administered, for example, by intranasal, buccal, oral, vaginal, inhalation, or other transmucosal administration. Examples are nafarelin (Synarel®) and calcitonin which are administered as commercial nasal spray formulations. The covalently modified peptides and/or proteins described herein are designed to facilitate such transmucosal administration and such formulations may be further facilitated through the use of small amounts of surfactants as described herein.

Typical formulation parameters include selection of optimum solution pH, buffer, and stabilizing excipients. Additionally, lyophilized cake reconstitution is important for lyophilized or powdered formulations. A further and significant problem comprises changes in viscosity of the protein formulation upon self-association. Changes in viscosity can significantly alter delivery properties e.g., in spray (aerosol) delivery for intranasal, pulmonary, or oral cavity sprays. Furthermore, increased viscosity can make injection delivery by syringe or iv line more difficult or impossible.

Many attempts to stabilize and maintain the integrity and physiological activity of peptides have been reported. Some attempts have produced stabilization against thermal denaturation and aggregation, particularly for insulin pump systems. Polymeric surfactants are described (Thurow, H. and Geisen, K. (1984) Diabetologia 27: 212-218; Chawla, A. S., et al. (1985) Diabetes 34: 420-424). The stabilization of insulin by these compounds was believed to be of a steric nature. Among other systems used are saccharides (Arakawa, T. and Timasheff, S. N. (1982) Biochemistry 21: 6536-6544), osmolytes, such as amino acids (Arakawa, T. and Timasheff, S. N. (1985) Biophys J 47: 411-414), and water structure breakers, such as urea (Sato, S., et al. (1983) J Pharm Sci 72: 228-232). These compounds exert their action by modulating the intramolecular hydrophobic interaction of the protein or peptide.

Various peptides, peptides, or proteins are described herein and may be modified with any of the covalently bound surfactant reagents described herein. Advantageously, the peptide modifications described herein comprise covalent attachment of a surfactant that comprises both hydrophilic (e.g. saccharide) and hydrophobic (e.g. alkyl chain) groups, thereby allowing for stabilization of the peptide in physiological conditions. In some embodiments, covalent linkage of a moiety comprising a hydrophilic group and hydrophobic group (e.g. a glycoside surfactant) to a peptide, and/or protein described herein eliminates the need for modifying the amino acid sequence of the peptide, and/or protein to enhance stability (e.g., reduce aggregation).

In some embodiments, the formulations comprise at least one drug comprising a peptide modified with a surfactant derived reagent described herein and in formulation additionally may be associated with a surfactant, wherein the surfactant is further comprised of, for example, a saccharide, an alkyl glycoside, or other excipient and can be administered in a format selected from the group consisting of a drop, a spray, an aerosol, a lyophilizate, a spray dried product, an injectable, and a sustained release format. The spray and the aerosol can be achieved through use of the appropriate dispenser and may be administered by intranasal, transbuccal, inhalation or other transmucosal route. The lyophilizate may contain other compounds such as mannitol, saccharides, submicron anhydrous α-lactose, gelatin, biocompatible gels or polymers. The sustained release format can be an ocular insert, erodible microparticulates, hydrolysable polymers, swelling mucoadhesive particulates, pH sensitive microparticulates, nanoparticles/latex systems, ion-exchange resins and other polymeric gels and implants (Ocusert, Alza Corp., California; Joshi, A., S. Ping and K. J. Himmelstein, Patent Application WO 91/19481). Significant oral bioavailability is also achievable.

The peptide and protein modifications described herein mitigate and, in some cases, may eliminate the need for organic solvents. Trehalose, lactose, and mannitol and other saccharides have been used to prevent aggregation. Aggregation of an anti-IgE humanized monoclonal antibody was minimized by formulation with trehalose at or above a molar ratio in the range of 300:1 to 500:1 (excipient:protein). However, the powders were excessively cohesive and unsuitable for aerosol administration or exhibited unwanted protein glycation during storage (Andya, J. D., et al. (1999) Pharm Res 16: 350-358). Each of the additives discovered have limitations as additives to therapeutics including xenobiotic metabolism, irritation or toxicity, or high cost. Contemplated for use with the covalently modified peptides and/or proteins described herein are excipients that are effective, non-irritating and non-toxic, do not require xenobiotic metabolism since they are comprised of the natural sugars, fatty acids, or long chain alcohols, and which may also be used to minimize aggregation in aqueous solutions or upon aqueous reconstitution of dried peptide and/or protein formulations in situ by physiologic aqueous reconstitution by aqueous body fluids such as plasma or saliva.

Other formulation components could include buffers and physiological salts, non-toxic protease inhibitors such as aprotinin and soybean trypsin inhibitor, alpha-1-antitrypsin, and protease-inactivating monoclonal antibodies, among others. Buffers could include organics such as acetate, citrate, gluconate, fumarate, malate, polylysine, polyglutamate, chitosan, dextran sulfate, etc. or inorganics such as phosphate, and sulfate. Such formulations may additionally contain small concentrations of bacteriostatic agents like benzyl alcohol, and the like.

Formulations suitable for intranasal administration also comprise solutions or suspensions of the modified peptides and/or protein products described herein in an acceptable evaporating solvents such as hydrofluoroalkanes. Such formulations are suitable for administration from metered dose inhalers (MDI) and have advantages of lack of movement from site of administration, low irritation and absence of need for sterilization. Such formulations may also contain acceptable excipients or bulking agents such as submicron anhydrous α-lactose.

In yet another aspect, the covalently modified peptides and/or proteins described herein exhibit increased shelf-life. As used herein, the phrase "shelf life" is broadly described as the length of time a product may be stored without becoming unsuitable for use or consumption. The "shelf life" of the composition described herein, can also indicate the length of time that corresponds to a tolerable loss in quality of the composition. The compositional shelf life as used herein is distinguished from an expiration date; "shelf life" relates to the quality of the composition described herein, whereas "expiration date" relates more to manufacturing and testing requirements of the composition. For example, a composition that has passed its "expiration date" may still be safe and effective, but optimal quality is no longer guaranteed by the manufacturer.

Dosing

The covalently modified peptides and/or proteins described herein may be administered in any amount to impart beneficial therapeutic effect in a number of disease states. In some embodiments, covalently modified peptides and/or proteins described herein are useful in the treatment of inflammation. In an embodiment, compounds presented herein impart beneficial activity in the modulation of post-operative or chronic pain. In an embodiment, the peptides are administered to a patient at concentrations higher or lower than that of other forms of treatment which modulate pain. In yet another embodiment, the peptides are administered with other compounds to produce synergistic therapeutic effects.

Representative delivery regimens include oral, transmucosal administration, parenteral (including subcutaneous, intraperitoneal, intramuscular and intravenous injection), rectal, buccal (including sublingual), transdermal, inhalation, ocular and transmucosal (including intranasal) modes of administration. An attractive and widely used method for delivery of peptides entails subcutaneous injection of a controlled-release injectable formulation. In some embodiments, covalently modified peptides and/or proteins described herein are useful for subcutaneous, intranasal and inhalation administration. Moreover, depending on the condition being treated, these therapeutic compositions are administered systemically or locally. Techniques for formulation and administration may be found in the latest edition of "Remington's Pharmaceutical Sciences" (Mack Publishing Co, Easton Pa.).

The selection of the exact dose and composition and the most appropriate delivery regimen will be influenced by, inter alia, the pharmacological properties of the selected peptide, the nature and severity of the condition being treated, and the physical condition and mental acuity of the recipient. Additionally, the route of administration will result in differential amounts of absorbed material. Bioavailabilities for administration of peptides through different routes are particularly variable, with amounts from less than 1% to near 100% being seen. Typically, bioavailability from routes other than intravenous, intraperitoneal or subcutaneous injection are 50% or less.

In general, covalently modified peptides and/or proteins described herein, or salts thereof, are administered in amounts between about 0.1 and 1000 g/kg body weight per day, or between about 0.1 to about 100 g/kg body weight per day, by subcutaneous injection. For a 50 kg human female subject, the daily dose of active ingredient is from about 5 to about 5000 g, or from about 5 to about 5000 g by subcutaneous injection. Different doses will be needed, depending on the route of administration, the compound potency, the pharmacokinetic profile and the applicable bioavailability observed. By inhalation, the daily dose is from 1000 to about 20,000 g, twice daily. In other mammals, such as horses, dogs, and cattle, higher doses may be required. This dosage may be delivered in a conventional pharmaceutical composition by a single administration, by multiple applications, or via controlled release, as needed to achieve the most effective results.

Administration of any covalently modified peptides and/or proteins described herein, or salts thereof, may follow any suitable dosing schedule. In some embodiments, the dosage is administered daily, weekly, every two weeks, or monthly. In some embodiments, the dosage is administered once weekly or twice weekly. In other embodiments, the dosage is administered three times weekly, four times weekly, five times weekly, six times weekly or seven times weekly. In some embodiments, the dosage is administered once a day, twice a day, or once every two days. In some embodiments, the composition is administered once every three days, once every four days, once every five days, or once every six days. In some embodiments, the dosage is administered monthly.

Pharmaceutically acceptable salts retain the desired biological activity of the parent peptide without toxic side effects. Examples of such salts are (a) acid addition salts formed with inorganic acids, for example hydrochloric acid, hydrobromic acid, sulfuric acid, phosphoric acid, nitric acid and the like; and salts formed with organic acids such as, for example, acetic acid, trifluoroacetic acid, tartaric acid, succinic acid, maleic acid, fumaric acid, gluconic acid, citric acid, malic acid, ascorbic acid, benzoic acid, tannic acid, pamoic acid, alginic acid, polyglutamic acid, naphthalenesulfonic acids, naphthalene disulfonic acids, polygalacturonic acid and the like; (b) base addition salts or complexes formed with polyvalent metal cations such as zinc, calcium, bismuth, barium, magnesium, aluminum, copper, cobalt, nickel, cadmium, and the like; or with an organic cation formed from N,N'-dibenzylethylenediamine or ethylenediamine; or (c) combinations of (a) and (b), e.g., a zinc tannate salt and the like.

Also contemplated, in some embodiments, are pharmaceutical compositions comprising as an active ingredient covalently modified peptides and/or proteins described herein, or pharmaceutically acceptable salt thereof, in admixture with a pharmaceutically acceptable, non-toxic carrier. As mentioned above, such compositions may be prepared for parenteral (subcutaneous, intramuscular or intravenous) administration, particularly in the form of liquid solutions or suspensions; for oral or buccal administration, particularly in the form of tablets or capsules; for intranasal administration, particularly in the form of powders, nasal drops, evaporating solutions or aerosols; for inhalation, particularly in the form of liquid solutions or dry powders with excipients, defined broadly; and for rectal or transdermal administration.

The compositions may conveniently be administered in unit dosage form and may be prepared by any of the methods well-known in the pharmaceutical art, for example as described in Remington's Pharmaceutical Sciences, 17th ed., Mack Publishing Company, Easton, Pa., (1985), incorporated herein by reference. Formulations for parenteral administration may contain as excipients sterile water or saline, alkylene glycols such as propylene glycol, polyalkylene glycols such as polyethylene glycol, saccharides, oils of vegetable origin, hydrogenated naphthalenes, serum albumin nanoparticles (as used in Abraxane™, American Pharmaceutical Partners, Inc. Schaumburg IL), and the like. For oral administration, the formulation can be enhanced by the addition of bile salts or acylcarnitines. Formulations for nasal administration may be solid or solutions in evaporating solvents such as hydrofluorocarbons, and may contain excipients for stabilization, for example, saccharides, surfactants, submicron anhydrous α-lactose or dextran, or may be aqueous or oily solutions for use in the form of nasal drops or metered spray. For buccal administration typical excipients include sugars, calcium stearate, magnesium stearate, pregelatinated starch, and the like.

When formulated for nasal administration, the absorption across the nasal mucous membrane may be further enhanced by surfactants, such as for example, glycocholic acid, cholic acid, taurocholic acid, ethocholic acid, deoxycholic acid, chenodeoxycholic acid, dehydrocholic acid, glycodeoxycholic acid, cyclodextrins and the like in an amount in the range between about 0.1 and 15 weight percent, between about 0.5 and 4 weight percent, or about 2 weight percent. An additional class of absorption enhancers reported to exhibit greater efficacy with decreased irritation is the class of alkyl maltosides, such as tetradecylmaltoside (Arnold, J. J., et al. (2004) J Pharm Sci 93: 2205-2213, Ahsan, F., et al. (2001) Pharm Res 18: 1742-1746) and references therein, all of which are hereby incorporated by reference.

When formulated for delivery by inhalation, a number of formulations offer advantages. Adsorption of the active peptide to readily dispersed solids such as diketopiperazines (for example Technosphere particles; (Pfutzner, A. and Forst, T. (2005) Expert Opin Drug Deliv 2: 1097-1106) or similar structures gives a formulation which results in a rapid initial uptake of the therapeutic agent. Lyophilized powders, especially glassy particles, containing the active peptide and an excipient are useful for delivery to the lung with good bioavailability, for example, see Exubera® (inhaled insulin by Pfizer and Aventis Pharmaceuticals Inc.). Additional systems for delivery of peptides by inhalation are described (Mandal, T. K., Am. J. Health Syst. Pharm. 62: 1359-64 (2005)).

Delivery of covalently modified peptides and/or proteins described herein to a subject over prolonged periods of time, for example, for periods of one week to one year, may be accomplished by a single administration of a controlled release system containing sufficient active ingredient for the desired release period. Various controlled release systems, such as monolithic or reservoir-type microcapsules, depot implants, polymeric hydrogels, osmotic pumps, vesicles, micelles, liposomes, transdermal patches, iontophoretic devices and alternative injectable dosage forms may be utilized for this purpose. Controlled release excipients have also been developed for twice weekly or weekly administrations, for example, a protected graft copolymer system (Castillo, G. M., et al. (2012) Pharm Res 29: 306-18) can be used for hydrophobic or hydrophobically modified peptides such as those of the invention. Localization at the site to which delivery of the active ingredient is desired is an additional feature of some controlled release devices, which may prove beneficial in the treatment of certain disorders.

One form of controlled release formulation contains the peptide or its salt dispersed or encapsulated in a slowly degrading, non-toxic, non-antigenic polymer such as copoly(lactic/glycolic) acid, as described in the pioneering work of Kent, Lewis, Sanders, and Tice, U.S. Pat. No. 4,675,189, incorporated by reference herein. The compounds, or their salts, may also be formulated in cholesterol or other lipid matrix pellets, or silastomer matrix implants. Additional slow release, depot implant or injectable formulations will be apparent to the skilled artisan. See, for example, Sustained and Controlled Release Drug Delivery Systems, J. R. Robinson ed., Marcel Dekker, Inc., New York, 1978, and R. W. Baker, Controlled Release of Biologically Active Agents, John Wiley & Sons, New York, 1987.

An additional form of controlled-release formulation comprises a solution of a biodegradable polymer, such as copoly(lactic/glycolic acid) or block copolymers of lactic acid and PEG, is bioacceptable solvent, which is injected subcutaneously or intramuscularly to achieve a depot formulation. Mixing of the peptides described herein with such a polymeric formulation is suitable to achieve very long duration of action formulations.

As used herein, "therapeutically effective amount" is interchangeable with "effective amount" for purposes herein, and is determined by such considerations as are known in the art. The amount must be effective to achieve a desired drug-mediated effect in the treated subjects suffering from the disease thereof. A therapeutically effective amount also includes, but is not limited to, appropriate measures selected by those skilled in the art, for example, improved survival rate, more rapid recovery, or amelioration, improvement or elimination of symptoms, or other acceptable biomarkers or surrogate markers.

It will be understood, however, that the specific dose level and frequency of dosage for any particular subject in need of treatment may be varied and will depend upon a variety of factors including the activity of the specific compound employed, the metabolic stability and duration of action of that compound, the age, body weight, general health, sex, diet, mode and time of administration, rate of excretion, drug combination, the severity of the particular condition, and the host undergoing therapy.

The dosing method(s) includes all aspects of the compositions described herein including but not limited to compositions which reduce or eliminate immunogenicity of peptide and/or protein drugs, are non-irritating, have anti-bacterial or anti-fungal activity, have increased stability or bioavailability of a drug, decrease the bioavailability variance of that drug, avoid first pass liver clearance and reduce or eliminate any adverse effects. As used herein, the term "immunogenicity" is the ability of a particular substance or composition or agent to provoke an immunological response. The immunogenicity of the covalently modified peptides and/or proteins described herein is confirmed by methods known in the art.

All publications and patent applications mentioned in this specification are herein incorporated by reference to the same extent as if each independent publication or patent application is specifically and individually indicated to be incorporated by reference.

The covalently modified peptides and/or proteins described herein and the reagents for the synthesis thereof are more particularly described in the following examples which are intended as illustrative only since numerous modifications and variations therein will be apparent to those of ordinary skill in the art.

EXAMPLES

Example 1: Reagents—N-α-Fmoc, N-ε-(1-octyl β-D-glucuronide-6-yl)-L-lysine

In an oven-dried 250 mL Erlenmeyer flask is placed 1-octyl β-D-glucuronic acid (Carbosynth Ltd., 3.06 g, 10 mmol), 50 mL anhydrous DMF, and anhydrous 1-hydroxybenzotriazole (1.62 g, 12 mmol). A chilled (4° C.) solution of N,N'-dicyclohexylcarbodiimide (2.48 g, 12 mmol) in 50 mL of DMF is added, with stirring, and the reaction is allowed to proceed for 5 min. The copious white precipitate of N,N'-dicyclohexylurea is filtered on a fritted glass funnel and the filtrate is added to a solution of N-α-Fmoc-L-lysine (3.68 g, 10 mmol) in 25 ml anhydrous DMF. The reaction is allowed to proceed for 25 min with warming to room temp or until the ninhydrin color is very faint. The reaction mixture is filtered, stripped to dryness and crystallized from MeOH/$Et_2O$ by dissolution in MeOH and slow dilution to the cloud point with $Et_2O$, followed by refrigeration. Further purification can be achieved by silica gel chromatography using a solvent gradient from EtOAc to EtOAc/EtOH/AcOH.

In a similar manner, but substituting N-α-Boc-L-lysine is obtained N-α-Boc,N-ε-(1-octyl β-D-glucuronide-6-yl)-L-lysine, suitable for N-terminal incorporation and cleavage to a free N-Terminus. In a similar manner, but substituting N-α-Ac-L-lysine is obtained N-α-Ac,N-ε-(1-octyl β-D-glucuronide-6-yl)-L-lysine, suitable for incorporation at the N-terminus of a peptide with a blocked N-terminus. In a similar manner, but substituting the appropriate amount of N-α-Fmoc-L-ornithine is obtained N-α-Fmoc,N-δ-(1-octyl β-D-glucuronide-6-yl)-L-ornithine. In a similar manner but substituting other N-mono-protected diamino acids one obtains the corresponding reagents. Alternatively, use of a transient $Me_3Si$ ester protecting group during the coupling and without preactivation of the 1-octyl β-D-glucuronic acid provides a facile route to the formation of the reagents. The transient $Me_3Si$ ester is produced by reaction of the Fmoc-Lys-OH with an equimolar amount of N,O-bis(trimethylsilyl)acetamide in dichloromethane ($CH_2Cl_2$). The organic layer contains the desired reagent as a solution in $CH_2Cl_2$ ready for coupling with the 1-alkyl glucoronide as above. The filtered reaction mixture is washed with aqueous $NaHSO_4$ to hydrolyze the $Me_3Si$ ester, dried over $MgSO_4$ and solvent is removed.

Similarly, but using peracetyl or perbenzoyl 1-octyl β-D-glucuronic acid one obtains the Ac, or Bz protected form of the reagents (e.g. 2,3,4-trisacetyl 1-octyl β-D-glucuronic acid, and the like, formed by treatment with $Ac_2O$). Such reagents have increased stability during acid cleavage from the resin and are used when instability during deprotection is detected, see (Kihlberg, J., et al. (1997) Methods Enzymol 289: 221-245) and references therein. Final deprotection of such products is carried out by base-catalyzed transesterification after cleavage, by use of MeOH/$NH_3$, MeOH/NaOMe, MeOH/$NH_2NH_2$, as described above.

Example 2: Synthetic Peptide Analogs

In general, peptide synthesis methods involve the sequential addition of protected amino acids to a growing peptide chain. Normally, either the amino or carboxyl group of the first amino acid and any reactive side chain group are protected. This protected amino acid is then either attached to an inert solid support, or utilized in solution, and the next amino acid in the sequence, also suitably protected, is added under conditions amenable to formation of the amide linkage. After all the desired amino acids have been linked in the proper sequence, protecting groups and any solid support are removed to afford the crude peptide. The peptide is desalted and purified chromatographically.

A preferred method of preparing the analogs of the physiologically active truncated peptides, having fewer than about fifty amino acids, involves solid phase peptide synthesis. In this method the α-amino (Nα) functions and any reactive side chains are protected by acid- or base-sensitive groups. The protecting group should be stable to the conditions of peptide linkage formation, while being readily removable without affecting the extant peptide chain. Suitable α-amino protecting groups include, but are not limited to t-butyloxycarbonyl (Boc), benzyloxycarbonyl (Cbz), o-chlorobenzyloxycarbonyl, biphenylisopropyloxycarbonyl, t-amyloxycarbonyl (Amoc), isobornyloxycarbonyl, α,α-dimethyl-3,5-dimethoxybenzyloxy-carbonyl, o-nitrophenylsulfenyl, 2-cyano-t-butoxycarbonyl, 9-fluorenylmethoxycarbonyl (Fmoc) and the like, preferably Boc or more preferably, Fmoc. Suitable side chain protecting groups include, but are not limited to: acetyl, benzyl (Bzl), benzyloxymethyl (Bom), Boc, t-butyl, o-bromobenzyloxycarbonyl, t-butyl, t-butyldimethylsilyl, 2-chlorobenzyl (Cl-z), 2,6-dichlorobenzyl, cyclohexyl, cyclopentyl, isopropyl, pivalyl, tetrahydropyran-2-yl, tosyl (Tos), 2,2,4,6,7-pentamethyldihydrobenzofuran-5-sulfonyl (Pbf), trimethylsilyl and trityl. A preferred Na-protecting group for synthesis of the compounds is the Fmoc group. Preferred side chain protecting groups are O-t-Butyl group for Glu, Tyr, Thr, Asp and Ser; Boc group for Lys and Trp side chains; Pbf group for Arg; Trt group for Asn, Gln, and His. For selective modification of a Lys residue, orthogonal protection with a protecting group not removed by reagents that cleave the Fmoc or t-butyl based protecting groups is preferred. Preferred examples for modification of the Lys side chain include, but are not limited to, those removed by hydrazine but not piperidine; for example 1-(4,4-dimethyl-2,6-dioxocyclohex-1-ylidene)-3-methylbutyl (ivDde) or 1-(4,4-dimethyl-2,6-dioxocyclohex-1-ylidene)ethyl (Dde) and allyloxycarbonyl (Alloc).

The Fmoc-Lys(ivDde) or Fmoc-Lys(Dde) protecting group scheme is preferred in cases where side chain lactam formation is desired (Houston, M. E., Jr., et al. (1995) J Pept Sci 1: 274-282; Murage, E. N., et al. (2010) J Med Chem), since in this case Fmoc-Glu(O-Allyl) and Fmoc-Lys(Alloc) can be incorporated and used to provide transient protection, then deprotected for lactam formation while the Lys(Dde) protecting group remains for later removal and reaction with the functionalized surfactant. The side chain lactam between acidic and basic residue (e.g. Glu and Lys) is carried out after removal of the allyl-based protection by activation of the carboxyl side chain function with N,N'-diisopropylcarbodiimide (DIC)/1-hydroxybenzotriazole (HOBt) or 2-(1H-benzotriazole-1-yl)-1,1,3,3-tetramethylaminium hexafluorophosphate (HBTU)/N,N-di-isopropylethylamine (DIEA), using standard protocols well known to the art.

In solid phase synthesis, the C-terminal amino acid is first attached to a suitable resin support. Suitable resin supports are those materials which are inert to the reagents and reaction conditions of the stepwise condensation and deprotection reactions, as well as being insoluble in the media used. Examples of commercially available resins include styrene/divinylbenzene resins modified with a reactive group, e.g., chloromethylated co-poly-(styrene-divinylbenzene), hydroxymethylated co-poly-(styrene-divinylbenzene), and the like. Benzylated, hydroxymethylated phenylacetamidomethyl (PAM) resin is preferred for the preparation of peptide acids. When the C-terminus of the compound is an amide, preferred resins are p-methylbenzhydrylamino-co-poly(styrene-divinyl-benzene) resin, a 2,4 dimethoxybenzhydrylamino-based resin ("Rink amide"), 4-Hydroxymethylphenoxyacetyl aminomethyl resin (HMP Am) and the like. An especially preferred support for the synthesis of larger peptides are commercially available resins containing PEG sequences grafted onto other polymeric matricies, such as the Rink Amide-PEG and PAL-PEG-PS resins (Applied Biosystems) or similar resins designed for peptide amide synthesis using the Fmoc protocol. Thus in certain cases it is desirable to have an amide linkage to a PEG chain. It those cases it is convenient to link an N-Fmoc-amino-PEG-carboxylic acid to the amide forming resin above (e.g. Rink amide resin and the like). The first amino acid of the chain can be coupled as an N-Fmoc-amino acid to the amino function of the PEG chain. Final deprotection will yield the desired Peptide-NH-PEG-CO—$NH_2$ product.

Attachment to the PAM resin may be accomplished by reaction of the Na protected amino acid, for example the Boc-amino acid, as its ammonium, cesium, triethylammonium, 1,5-diazabicyclo-[5.4.0]undec-5-ene, tetramethylammonium, or similar salt in ethanol, acetonitrile, N,N-dimethylformamide (DMF), and the like, preferably the cesium salt in DMF, with the resin at an elevated temperature, for example between about 40° and 60° C., preferably about 50° C., for from about 12 to 72 hours, preferably about 48 hours. This will eventually yield the peptide acid product following acid cleavage or an amide following aminolysis.

The Nα-Boc-amino acid may be attached to the benzhydrylamine resin by means of, for example, a (DIC)/HOBt mediated coupling for from about 2 to about 24 hours, preferably about 2 hours at a temperature of between about 10° and 50° C., preferably 25° C. in a solvent such as $CH_2Cl_2$ or DMF, preferably $CH_2Cl_2$.

For Boc-based protocols, the successive coupling of protected amino acids may be carried out by methods well known in the art, typically in an automated peptide synthesizer. Following neutralization with triethylamine, DIEA, N-methylmorpholine (NMM), collidine, or similar base, each protected amino acid is introduced in approximately about 1.5 to 2.5 fold molar excess and the coupling carried out in an inert, nonaqueous, polar solvent such as $CH_2Cl_2$, DMF, N-methylpyrrolidone (NMP), N,N-dimethylacetamide (DMA), or mixtures thereof, preferably in dichloromethane at ambient temperature. For Fmoc-based protocols no acid is used for deprotection but a base, preferably DIEA or NMM, is usually incorporated into the coupling mixture. Couplings are typically done in DMF, NMP, DMA or mixed solvents, preferably DMF. Representative coupling agents are N,N'-dicyclohexylcarbodiimide (DCC), N,N'-diisopropyl-carbodiimide (DIC) or other carbodiimide, either alone or in the presence of HOBt, O-acyl ureas, benzotriazol-1-yl-oxytris(pyrrolidino)phosphonium hexafluorophosphate (PyBop), N-hydroxysuccinimide, other N-hydroxyimides, or oximes. Alternatively, protected amino acid active esters (e.g. p-nitrophenyl, pentafluorophenyl and the like) or symmetrical anhydrides may be used. Preferred coupling agents are of the aminium/uronium (alternative nomenclatures used by suppliers) class such as HBTU, O-(7-azabenzotriazole-1-yl)-1,1,3,3-tetramethyluronium hexafluorophosphate (HATU), 2-(6-Chloro-1H-benzotriazole-1-yl)-1,1,3,3-tetramethylaminium hexafluorophosphate (HCTU), and the like.

A preferred method of attachment to the Fmoc-PAL-PEG-PS resin may be accomplished by deprotection of the resin linker with 20% piperidine in DMF, followed by reaction of the N-α-Fmoc protected amino acid, about a 5 fold molar excess of the N-α-Fmoc-amino acid, using HBTU: diisopropylethylamine (DIEA) (1:2) in DMF in a microwave-assisted peptide synthesizer with a 5 min, 750 max coupling cycle.

For this Fmoc-based protocol in the microwave-assisted peptide synthesizer, the N-α-Fmoc amino acid protecting groups are removed with 20% piperidine in DMF containing 0.1M 1-hydroxybenzotriazole (HOBt), in a double deprotection protocol for 30 see and then for 3 min with a temperature maximum set at 75° C. HOBt is added to the deprotection solution to reduce aspartimide formation. Coupling of the next amino acid then employs a five-fold molar excess using HBTU:DIEA (1:2) with a 5 min, 750 max. double-coupling cycle.

At the end of the solid phase synthesis the fully protected peptide is removed from the resin. When the linkage to the resin support is of the benzyl ester type, cleavage may be effected by means of aminolysis with an alkylamine or fluoroalkylamine for peptides with an alkylamide C-terminus, or by ammonolysis with, for example, ammonia/methanol or ammonia/ethanol for peptides with an unsubstituted amide C-terminus, at a temperature between about −10° and 50° C., preferably about 25° C., for between about 12 and 24 hours, preferably about 18 hours. Peptides with a hydroxy C-terminus may be cleaved by HF or other strongly acidic deprotection regimen or by saponification. Alternatively, the peptide may be removed from the resin by transesterification, e.g., with methanol, followed by aminolysis or saponification. The protected peptide may be purified by silica gel or reverse-phase HPLC.

The side chain protecting groups may be removed from the peptide by treating the aminolysis product with, for example, anhydrous liquid hydrogen fluoride in the presence of anisole or other carbonium ion scavenger, treatment with hydrogen fluoride/pyridine complex, treatment with tris(trifluoroacetyl)boron and trifluoroacetic acid, by reduction with hydrogen and palladium on carbon or polyvinylpyrrolidone, or by reduction with sodium in liquid ammonia, preferably with liquid hydrogen fluoride and anisole at a temperature between about −10° and +10° C., preferably at about 0° C., for between about 15 minutes and 2 hours, preferably about 1.5 hours.

For peptides on the benzhydrylamine type resins, the resin cleavage and deprotection steps may be combined in a single step utilizing liquid hydrogen fluoride and anisole as described above or preferably through the use of milder cleavage cocktails. For example, for the PAL-PEG-PS resin, a preferred method is through the use of a double deprotection protocol in the microwave-assisted peptide synthesizer using one of the mild cleavage cocktails known in the art, such as TFA/water/tri-iso-propylsilane/3,6-dioxa-1,8-octanedithiol (DODT) (92.5/2.5/2.5/2.5) for 18 min at 38° C. each time. Cleavage of alkyl glycoside containing materials have shown survival of the alkyl glycoside linkage using protocols with TFA/water ratios in the 9/1 to 19/1 range. A typical cocktail is 94% TFA: 2% EDT; 2% $H_2O$; 2% TIS. Typically the fully deprotected product is precipitated and washed with cold (−70° to 4° C.) $Et_2O$, dissolved in deionized water and lyophilized.

The peptide solution may be desalted (e.g. with BioRad AG-3® anion exchange resin) and the peptide purified by a sequence of chromatographic steps employing any or all of the following types: ion exchange on a weakly basic resin in the acetate form; hydrophobic adsorption chromatography on underivatized co-poly(styrene-divinylbenzene), e.g. Amberlite® XAD; silica gel adsorption chromatography; ion exchange chromatography on carboxymethylcellulose; partition chromatography, e.g. on Sephadex® G-25; counter-current distribution; supercritical fluid chromatography; or HPLC, especially reversed-phase HPLC on octyl- or octadecylsilylsilica (ODS) bonded phase column packing.

Also provided herein are processes for preparing covalently modified peptides and/or proteins described herein and pharmaceutically acceptable salts thereof, which processes comprise sequentially condensing protected amino acids on a suitable resin support, removing the protecting groups and resin support, and purifying the product, to afford analogs of the physiologically active truncated homologs and analogs of the covalently modified peptides and/or proteins described herein. In some embodiments, covalently modified peptides and/or proteins described herein incorporate alkyl glycoside modifications as defined above. Another aspect relates to processes for preparing covalently modified peptides and/or proteins described herein and pharmaceutically acceptable salts thereof, which processes comprise the use of microwave-assisted solid phase synthesis-based processes or standard peptide synthesis protocols to sequentially condense protected amino acids on a suitable resin support, removing the protecting groups and resin support, and purifying the product, to afford analogs of the physiologically active peptides, as defined above.

Example 3. General Oxidation Method for Uronic Acids

To a solution of 1-dodecyl β-D-glucopyranoside (Carbosynth) [2.0 g, 5.74 mmol] in 20 mL of acetonitrile and 20 mL of DI water was added (diacetoxyiodo)benzene (Fluka) [4.4 g, 13.7 mmol] and TEMPO (SigmaAldrich) [0.180 g, 1.15 mmol]. The resulting mixture was stirred at room temperature for 20 h. The reaction was followed by mass spectrometry (for example LCQ ESI) and upon completion, the reaction mixture was diluted with water and lyophilized to dryness to give 1.52 g (crude yield 73.1%) of the crude product, 1-dodecyl β-D-glucuronic acid, as a white powder, which was used directly for the solid phase synthesis without further purification. This product was previously prepared by an alternative process using NaOCl as oxidant, as described in the specification, and also has been used for longer alkyl groups. For longer alkyl groups 1,4-dioxane was used instead of acetonitrile and the temperature was raised as high as 30° C. In a similar manner are prepared the desired alkyl saccharide uronic acids used to make the products and reagents described herein.

In a like manner, but using, for example, the corresponding 1-octyl, 1-decyl, 1-undecyl, 1-tetradecyl, 1-hexadecyl, and 1-octadecyl glycosides (purchased from Anatrace, Maumee, OH) were prepared the desired 1-alkyl saccharide uronic acids which were used to make the products and reagents described herein. In a like manner, but using, for example, the corresponding 1-octyl, 1-decyl, 1-undecyl, 1-tetradecyl, 1-hexadecyl, and 1-octadecyl β-D-melibiosides or R-D-maltosides (purchased from Anatrace, Maumee, OH) were prepared the desired 1-alkyl disaccharide uronic acids which were used to make the products and reagents described herein.

Example 4: Preparation of Analog EU-A387

A sample of Fmoc-His-Aib-Gln-Gly-Thr-Phe-Thr-Ser-Asp-Bip-Ser-Lys-Tyr-Leu-Glu-Ser-Lys(Alloc)-Rink amide resin (SEQ ID NO: 808)_was prepared by sequential addition of N-alpha-Fmoc protected amino acids as described in Example 1 and deprotected on the Lys-N-epsilon position by incubation with $Pd(PPh_3)_4$ (0.5 eq) and DMBA (20 eq) in $DMF/CH_2Cl_2$ (1:1) overnight in the dark at room temperature. Following washing by $DMF/CH_2Cl_2$, the Lys side chain was acylated with 1'-dodecyl β-D-glucuronic acid in $DMF/CH_2Cl_2$ through the use of DIC/HOBt. Completion of the coupling was checked by ninhydrin and the product was washed extensively with $CH_2Cl_2$.

The product resin is submitted to final deprotection and cleavage from the resin by treatment with the cleavage cocktail (94% TFA: 2% EDT; 2% $H_2O$; 2% TIS) for a period of 240 min at room temperature. The mixture was treated with $Et_2O$, to precipitate the product and washed extensively with $Et_2O$ to yield the crude title peptide product after drying in vacuo.

Purification is carried out in two batches by reversed phase (C18) hplc. The crude peptide was loaded on a 4.1×25 cm hplc column at a flow rate of 15 mL/min (15% organic modifier; acetic acid buffer) and eluted with a gradient from 15-45% buffer B in 60 min at 50° C. The product fraction is lyophilized to yield the title product peptide with a purity 98.03% by analytical hplc (18.6 min; 30-60% $CH_3CN$ in 0.1% TFA)/mass spectrometry (M+1 peak=2382.14). In a similar manner were prepared the other analogs of the invention, the characterization of which is illustrated below.

The corresponding 1-methyl and 1-octyl analogs of the title compound are prepared in a similar manner, but using the reagents 1'-methyl β-D-glucuronic acid and 1'-octyl β-D-glucuronic acid (Carbosynth). The corresponding 1-decyl, 1-dodecyl, 1-tetradecyl, 1-hexadecyl, 1-octadecyl and 1-eicosyl analogs are prepared using the corresponding glucouronic acids, prepared as described above. Alternatively, the 1-alkyl glucuronyl, or other uronic acylated analogs, may be prepared by initial purification of the deprotected or partially deprotected peptide followed by acylation by the desired uronic acid reagent.

Example 5: Preparation of Analog EU-A1024

A sample of Boc-His(Trt)-Aib-Gln(Trt)-Gly-Thr(tBu)-Phe-Thr(tBu)-Ser(tBu)-Asp(OtBu)-Tyr(tBu)-Ser(tBu)-Lys(Boc)-Tyr(tBu)-Leu-Asp(OtBu)-Glu(O-Allyl)-Gln(Trt)-Ala-Ala-Lys(Alloc)-Glu(O-tBu)-Phe-Ile-Lys(Dde)-Trp(Boc)-Leu-Leu- Gln(Trt)-Thr(tBu)-HMP amide resin (SEQ ID NO: 809) (started from Fmoc-Thr(tBu)-HMP Am Resin, substitution 0.45 mmol/g) was prepared by sequential addition of N-alpha-Fmoc protected amino acids as described in Example 1. The allyl based side chains on Glu and Lys were deprotected by incubation with $Pd(PPh_3)_4$ (0.5 eq) and DMBA (20 eq) in $DMF/CH_2Cl_2$ (1:1) overnight in the dark at room temperature. The resin was washed with 0.5% DIEA in DMF (twice), 0.5% sodium diethyldithiocarbamate in DMF (twice) and $DMF/CH_2Cl_2$ until a light yellow resin was obtained. The side chain lactam linkage was formed by coupling the Glu and Lys with DIC/HOBT (5 equivalents) in DMF. The reaction was checked for completeness with ninhydrin and recoupled if necessary. Following washing by $DMF/CH_2Cl_2$, the Lys side chain was deprotected by incubation with 5% hydrazine hydrate in DMF (10 equivalents) twice, in each case for 15 min. Following washing by $DMF/CH_2Cl_2$ the side chain amino group of the deprotected Lys residue was reacted with 1'-tetradecyl β-D-melibiouronic acid in $DMF/CH_2Cl_2$ through the use of DIC/HOBt. Completion of the coupling was checked by ninhydrin and the product was washed extensively with $CH_2Cl_2$. Any couplings which were not complete by ninhydrin were rerun. In general, 10-12 g of peptide product resin was obtained from a 2 mmole synthesis.

The product resin was submitted to final deprotection and cleavage from the resin by treatment with the cleavage cocktail (94% TFA: 2% EDT; 2% $H_2O$; 2% TIS) for a period of 240 min at room temperature. The mixture was treated with $Et_2O$, to precipitate the product and washed extensively with $Et_2O$ to yield the crude title peptide product after drying in vacuo. In general, 5 to 8 g crude product peptide was obtained.

Purification was carried out in two batches by reversed phase (C18) hplc. The crude peptide (1-1.5 g) was loaded on a 4.1×25 cm hplc column at a flow rate of 15 mL/min (15% organic modifier; 0.1% TFA buffer) and eluted with a gradient from 35-55% buffer B in 70 min at room temperature. Repurification of the less pure fractions was done for the fractions with a purity of >70%. The product fraction was lyophilized to yield the title product peptide with a purity 98.7% by analytical hplc (10.3 min; 45-75% $CH_3CN$ in 0.1% TFA)/mass spectrometry (1317.67, +3 charged; 1976.13, +2 charged; molecular weight 3950.44). In a similar manner were prepared the other analogs of the invention, the characterization of which is illustrated below.

The corresponding 1-methyl and 1-octyl analogs of the title compound are prepared in a similar manner, but using the reagents 1'-methyl β-D-glucuronic acid and 1'-octyl β-D-glucuronic acid (Carbosynth). In a like manner, but using the corresponding 1-octyl, 1-decyl, 1-undecyl, 1-tetradecyl, 1-hexadecyl, and 1-octadecyl β-D-glucouronic acids (prepared as described above) were prepared the products of the invention. In a like manner, but using the corresponding 1-octyl, 1-decyl, 1-undecyl, 1-tetradecyl, 1-hexadecyl, and 1-octadecyl β-D-melibiouronic or β-D-maltouronic (prepared as described above) were prepared the products and reagents described herein. Alternatively, the 1-alkyl glucuronyl, or other uronic acylated analogs, may be prepared by initial purification of the deprotected or partially deprotected peptide followed by acylation by the desired uronic acid reagent.

Analysis and characterization was done by HPLC/mass spectrometry in positive ion mode using the eluent gradients given in the table below.

| Compound Name | Molecular Wt Expected | Molecular Wt Found | HPLC (min; elution) |
|---|---|---|---|
| EU-A387 | 2379.66 | 2380.14 | 18.6 [b] |
| EU-A388 | 2393.69 | 2393.74 | 16.0 [a] |
| EU-A391 | 2317.62 | 2318.26 | 11.2 [b] |
| EU-A455 | 2988.36 | 2988.00 | 11.5 [b] |
| EU-A474 | 2570.86 | 2570.54 | 11.3 [b] |
| EU-A478 | 2459.75 | 2459.74 | 11.1 [b] |
| EU-A484 | 2544.86 | 2545.06 | 9.6 [b] |
| EU-A501 | 2904.2 | 2903.34 | 7.9 [b] |
| EU-A502 | 2776.07 | 2776.14 | 8.0 [b] |
| EU-A503 | 2704.98 | 2704.40 | 8.0 [b] |
| EU-A504 | 2548.80 | 2548.00 | 9.1 [b] |
| EU-A505 | 2392.61 | 2392.40 | 10.5 [b] |
| EU-A506 | 2305.53 | 2305.06 | 10.7 [b] |
| EU-A507 | 3763.23 | 3762.66 | 9.0 [b] |
| EU-A521 | 2303.56 | 2303.60 | 8.2 [c] |
| EU-A522 | 2315.60 | 2315.60 | 14.2 [d] |
| EU-A523 | 2615.94 | 2616.00 | 8.1 [b] |
| EU-A524 | 2459.75 | 2459.74 | 12.7 [d] |
| EU-A525 | 2459.75 | 2459.06 | 6.0 [c] |
| EU-A526 | 2473.75 | 2473.60 | 12.7 [d] |
| EU-A527 | 2390.64 | 2390.40 | 14.6 [d] |
| EU-A529 | 2546.83 | 2546.80 | 9.5 [b] |
| EU-A531 | 2546.83 | 2546.80 | 9.5 [b] |
| EU-A532 | 2559.00 | 2558.66 | 9.6 [b] |
| EU-A533 | 2560.96 | 2560.66 | 9.5 [b] |
| EU-A534 | 2544.99 | 2544.94 | 9.7 [b] |
| EU-A535 | 2573.05 | 2574.00 | 12.0 [b] |
| EU-A536 | 2602.96 | 2603.46 | 14.3 [b] |
| EU-A538 | 2516.99 | 2516.40 | 10.3 [b] |
| EU-A539 | 2657.20 | 2656.80 | 10.8 [b] |
| EU-A540 | 2685.20 | 2684.94 | 9.8 [c] |
| EU-A541 | 2713.20 | 2712.80 | 13.0 [c] |
| EU-A544 | 2631.94 | 2632.26 | 10.8 [b] |
| EU-A546 | 2687.94 | 2688.80 | 9.1 [c] |
| EU-A549 | 2388.67 | 2388.66 | 6.3 [e] |
| EU-A551 | 2444.67 | 2445.20 | 11.4 [e] |
| EU-A552 | 2472.67 | 2473.14 | 10.7 [f] |
| EU-A554 | 2560.86 | 2560.40 | 10.3 [c] |
| EU-A556 | 2616.86 | 2616.40 | 11.7 [e] |
| EU-A557 | 2644.86 | 2645.74 | 10.4 [f] |

-continued

| Compound Name | Molecular Wt Expected | Molecular Wt Found | HPLC (min; elution) |
|---|---|---|---|
| EU-A560 | 2570.86 | 2571.06 | 8.3 [c] |
| EU-A562 | 2626.86 | 2626.66 | 9.9 [e] |
| EU-A563 | 2654.86 | 2655.06 | 8.7 [f] |
| EU-A565 | 2542.80 | 2542.54 | 9.5 [c] |
| EU-A567 | 2598.80 | 2599.06 | 12.0 [e] |
| EU-A568 | 2626.80 | 2626.54 | 10.1 [f] |

HPLC gradients in 0.1% TFA
[a] 35 to 65% $CH_3CN$ over 30 min.
[b] 30 to 60% $CH_3CN$ over 20 min.
[c] 35 to 65% $CH_3CN$ over 20 min.
[d] 25 to 55% $CH_3CN$ over 20 min.
[e] 40 to 70% $CH_3CN$ over 20 min.
[f] 45 to 75% $CH_3CN$ over 20 min.
HPLC on Phenomenex Luna C18 5 micron 250 × 4.6 mm.

Additional compounds synthesized and analyzed as described above are:

| Compound Name | Molecular Wt Expected | Molecular Wt Found | HPLC (min; elution) |
|---|---|---|---|
| EU-A570 | 2656.16 | 2656.00 | 10.4 [b] |
| EU-A571 | 2684.16 | 2683.34 | 11.2 [c] |
| EU-A575 | 2670.16 | 2670.94 | 11.8 [b] |
| EU-A576 | 2698.16 | 2697.20 | 11.2 [c] |
| EU-A580 | 2668.20 | 2667.20 | 12.3 [b] |
| EU-A581 | 2696.20 | 2695.46 | 11.1 [c] |
| EU-A592 | 2724.20 | 2724.58 | 9.9 [e] |
| EU-A595 | 2682.20 | 2682.40 | 9.7 [c] |
| EU-A596 | 2710.20 | 2710.46 | 10.4 [c] |
| EU-A597 | 2738.20 | 2738.18 | 10.9 [e] |
| EU-A721 | 2461.85 | 2461.74 | 10.3 [b] |
| EU-A722 | 2475.85 | 2475.34 | 10.8 [b] |
| EU-A723 | 2459.88 | 2459.86 | 7.7 [c] |
| EU-A724 | 2473.88 | 2473.34 | 11.1 [b] |
| EU-A725 | 2471.92 | 2472.00 | 10.8 [b] |
| EU-A726 | 2557.03 | 2556.80 | 11.0 [b] |
| EU-A727 | 2485.92 | 2485.74 | 10.9 [b] |
| EU-A728 | 2513.92 | 2513.86 | 10.6 [c] |
| EU-A729 | 2541.92 | 2541.86 | 9.7 [e] |
| EU-A730 | 2569.92 | 2569.74 | 9.4 [f] |
| EU-A731 | 2425.88 | 2425.32 | 10.6 [d] |
| EU-A732 | 2476.95 | 2476.40 | 9.4 [c] |
| EU-A733 | 2381.83 | 2382.02 | 11.4 [b] |
| EU-A734 | 2616.09 | 2616.18 | 11.4 [b] |
| EU-A750 | 1611.89 | 1611.56 | 9.4 [c] |
| EU-A751 | 1625.89 | 1625.35 | 9.7 [c] |
| EU-A752 | 1709.93 | 1709.41 | 11.7 [g] |
| EU-A753 | 1637.84 | 1637.46 | 12.5 [b] |
| EU-A754 | 1651.84 | 1651.18 | 9.9 [c] |
| EU-A755 | 1711.93 | 1711.46 | 10.3 [h] |
| EU-A756 | 1671.98 | 1671.37 | 9.8 [e] |
| EU-A757 | 1770.02 | 1769.17 | 14.9 [g] |
| EU-A770 | 3333.61 | 3334.65 | 9.5 [b] |
| EU-A771 | 3678.25 | 3677.96 | 11.3 [c] |
| EU-A772 | 3762.25 | 3763.35 | 14.9 [e] |
| EU-A773 | 3790.31 | 3791.31 | 11.1 [f] |
| EU-A774 | 3475.74 | 3477.15 | 10.5 [d] |
| EU-A775 | 3820.38 | 3821.52 | 10.4 [c] |
| EU-A776 | 3904.38 | 3905.76 | 10.2 [f] |
| EU-A777 | 3932.44 | 3933.69 | 9.7 [f] |
| EU-A792 | 3793.43 | 3793.52 | 8.9 [f] |
| EU-A793 | 3821.43 | 3821.60 | 10.8 [f] |
| EU-A794 | 3849.43 | 3848.78 | 10.5 [g] |
| EU-A945 | 3777.18 | 3777.54 | 12.2 [e] |
| EU-A948 | 3861.18 | 3862.14 | 13.0 [f] |
| EU-A993 | 3759.22 | 3759.00 | 9.3 [f] |
| EU-A994 | 3787.22 | 3787.44 | 11.4 [f] |
| EU-A995 | 3815.22 | 3815.52 | 14.5 [g] |
| EU-A996 | 3843.22 | 3843.12 | 12.3 [g] |
| EU-A999 | 3935.35 | 3934.66 | 13.4 [e] |
| EU-A1011 | 3854.21 | 3854.38 | 14.2 [c] |
| EU-A1017 | 3896.26 | 3895.77 | 12.3 [c] |
| EU-A1023 | 3921.35 | 3921.15 | 10.5 [e] |

-continued

| Compound Name | Molecular Wt Expected | Molecular Wt Found | HPLC (min; elution) |
|---|---|---|---|
| EU-A1024 | 3950.44 | 3949.95 | 10.3 [f] |
| EU-A1026 | 4005.55 | 4004.64 | 12.8 [g] |
| EU-A1029 | 3939.31 | 3939.06 | 10.7 [e] |
| EU-A1032 | 4023.51 | 4025.22 | 13.9 [f] |
| EU-A1035 | 3840.21 | 3838.21 | 9.8 [e] |
| EU-A1041 | 3882.26 | 3880.50 | 9.6 [e] |
| EU-A1044 | 3966.46 | 3965.46 | 12.6 [f] |
| EU-A1167 | 3731.15 | 3731.42 | 8.9 [f] |
| EU-A1168 | 3745.15 | 3745.20 | 10.8 [i] |
| EU-A1173 | 3978.49 | 3977.00 | 12.9 [f] |

HPLC gradients in 0.1% TFA
[a] 35 to 65% $CH_3CN$ over 30 min.
[b] 30 to 60% $CH_3CN$ over 20 min.
[c] 35 to 65% $CH_3CN$ over 20 min.
[d] 25 to 55% $CH_3CN$ over 20 min.
[e] 40 to 70% $CH_3CN$ over 20 min.
[f] 45 to 75% $CH_3CN$ over 20 min.
[g] 50 to 80% $CH_3CN$ over 20 min.
[h] 10 to 40% $CH_3CN$ over 20 min.
[i] 30 to 90% $CH_3CN$ over 20 min.
HPLC on was carried out on a Phenomenex Luna C18 5 micron 250 × 4.6 mm analytical column.

Example 6: Cellular Assay of the Compounds

Compounds were weighed precisely in an amount of approximately 1 mg and assayed in standard cellular assays (Cerep SA). The readout is the amount of cAMP generated in the cells treated with the test compounds, in either agonist or antagonist mode. The assay used was the stimulation of cAMP levels in the glucagon (human, cloned into CHO cells) and GLP-1 (murine cell line) cellular assays. The assays are described in Chicchi, G. G., et al. (1997) J Biol Chem 272: 7765-7769 and Runge, S., et al. (2003) Br J Pharmacol 138: 787-794.

For compound EU-A391 the GLCR cellular response does not change and the GLP1R cellular response rises steeply with and EC50 of 420 nM

| Compound | Structure | $EC_{50}$ GLP-1 R (nM) | $EC_{50}$ murine glucagon R (nM) |
|---|---|---|---|
| EU-A391 | 1-dodecyl | 420 | n.c. |
| EU-A455 | 1-dodecyl | 59 | 770 |
| EU-A474 | 1-dodecyl | 3000 | n.c. |
| EU-A478 | 1-dodecyl | n.c. | n.c. |
| EU-A484 | 1-dodecyl | n.c. | n.c. |
| EU-A501 | 1-dodecyl | 20000 | 12000 |
| EU-A502 | 1-dodecyl | 9400 | n.c. |
| EU-A503 | 1-dodecyl | n.c. | n.c. |
| EU-A504 | 1-dodecyl | 3100 | 1100 |
| EU-A505 | 1-dodecyl | 8500 | 6100 |
| EU-A506 | 1-dodecyl | 4600 | 1300 |
| EU-A507 | 1-dodecyl | 18 | 1 |
| EU-A521 | 1-dodecyl | n.c. | n.c. |
| EU-A522 | 1-dodecyl | n.c. | 9000 |
| EU-A523 | 1-dodecyl | n.c. | n.c. |
| EU-A524 | 1-dodecyl | n.c. | n.c. |
| EU-A525 | 1-dodecyl | n.c. | n.c. |
| EU-A526 | 1-dodecyl | n.c. | n.c. |
| EU-A527 | 1-dodecyl | n.c. | 5000 |
| EU-A529 | 1-dodecyl | n.c. | 7000 |
| EU-A531 | 1-dodecyl | 2100 | 1100 |
| EU-A532 | 1-dodecyl | 5000 | 2600 |
| EU-A533 | 1-dodecyl | 770 | 780 |
| EU-A534 | 1-dodecyl | 290 | 1900 |
| EU-A535 | 1-tetradecyl | §4800 | 2100 |
| EU-A536 | 1-hexadecyl | >10000 | 4400 |
| EU-A538 | 1-dodecyl | 270 | n.c. |

-continued

| Compound | Structure | $EC_{50}$ GLP-1 R (nM) | $EC_{50}$ murine glucagon R (nM) |
|---|---|---|---|
| EU-A539 | 1-dodecyl | 860 | 2300 |
| EU-A540 | 1-tetradecyl | n.c. | 8800 |
| EU-A541 | 1-hexadecyl | 800 | 5000 |

n.c. means EC50 not calculable

§ means superagonist

A further series of cellular assays were carried out using standard cellular assays (DiscoveRx, LeadHunter assays) using readout of cAMP stimulation or arrestin activation. Compounds were weighed precisely in an amount of approximately 1 mg and shipped to DiscoveRx for dilution and assay. The assay used were for the glucagon (human, cloned into CHO cells) and GLP-1 (human, cloned into CHO cells) receptors in cellular assays.

| Compound | $EC_{50}$ cAMP GLP-1 R (nM) | $EC_{50}$ arrestin GLP-1 R (nM) | $EC_{50}$ cAMP glucagon R (nM) | $EC_{50}$ arrestin glucagon R (nM) |
|---|---|---|---|---|
| EU-A507 | 0.01 | 9 | 0.02 | 100 |
| EU-A534 | 87 | | 1100 | |
| EU-A538 | 55 | | 3500 | |
| EU-A750 | >1000 | | >1000 | |
| EU-A751 | >1000 | | >1000 | |
| EU-A752 | 146 | | >1000 | |
| EU-A753 | >1000 | | >1000 | |
| EU-A754 | 360 | | >1000 | |
| EU-A755 | 486 | | 471 | |
| EU-A756 | 611 | | >1000 | |
| EU-A757 | 6.7 | | >1000 | |
| EU-A770 | 0.01 | 2.3 | 0.5 | >100 |
| EU-A771 | 0.07 | 14.2 | 0.4 | >100 |
| EU-A772 | 0.07 | 8.4 | 5.4 | >100 |
| EU-A773 | 0.08 | 8.3 | 1.5 | >100 |
| EU-A774 | 0.009 | 6.8 | 0.15 | 22.7 |
| EU-A775 | 0.16 | 17 | 0.3 | 33.6 |
| EU-A776 | 1.2 | >100 | 6.5 | >100 |
| EU-A777 | 0.1 | 34.5 | 0.6 | 73 |
| EU-A792 | <0.05 | 27.9 | <0.05 | |
| EU-A793 | <0.05 | 23.8 | <0.05 | |
| EU-A794 | 0.05 | 59.4 | 0.18 | |
| EU-A945 | <0.05 | 9.4 | 0.06 | |
| EU-A948 | 0.08 | 25.6 | 9.1 | |
| EU-A992 | 0.009 | | 0.019 | |
| EU-A993 | <0.05 | 12.3 | <0.05 | |
| EU-A994 | 0.05 | 10.2 | <0.05 | |
| EU-A995 | 0.035 | 59.5 | 0.15 | |
| EU-A996 | 0.05 | >100 | 0.87 | |
| EU-A999 | 0.05 | | 0.015 | |
| EU-A1011 | 0.16 | | 0.51 | |
| EU-A1017 | 0.44 | | 0.10 | |
| EU-A1023 | 0.028 | | 0.035 | |
| EU-A1029 | 0.019 | | 0.06 | |
| EU-A1032 | 0.03 | | 5.4 | |
| EU-A1035 | 0.02 | | 0.19 | |
| EU-A1041 | 0.02 | | 0.13 | |
| EU-A1044 | 0.07 | | 0.57 | |
| EU-A1167 | 0.013 | | 0.019 | |
| EU-A1168 | 0.07 | | 0.14 | |

Example 7: In Vivo Assay of Compounds—db/db Mice

The 60 female db/db B6BKS (D) Leprdb/J (strain 000697) mice for this study were approximately 8 to 9 weeks old at arrival (Jackson Laboratory, Bar Harbor, Maine). The mice were randomized by weight and two treatment groups of 8 female mice each were administered the test articles, EU-A994, EU-A995, or EU-A1026, at dose levels of 100 or 300 nmoles/kg. One group of 8 female mice served as the vehicle control and received the vehicle, 0.2% BSA in saline, pH 7.4. One additional group of 8 female mice received the positive control article, liraglutide, at a dose level of 50 nmoles/kg. The test articles, vehicle, and positive control article were administered on Day 1, at approximately 0, 7, and 24 hours during the study via subcutaneous injection at a dose volume of 6 mL/kg.

Clinical observations were conducted at receipt, prior to randomization, and daily from Days 1 to 5. Body weights were measured and recorded at receipt, prior to randomization, and daily from Days 1 to 5. Food consumption was measured and recorded daily from Days 1 to 5. Blood samples for glucose analysis were collected pretest (Day −3) and at 0, 1, 2, 4, 8, 10, 24, 48, 72, and 96 hours following the first dose on Day 1. At study termination all animals were euthanized and the carcasses were discarded without further evaluation.

Figure 5:
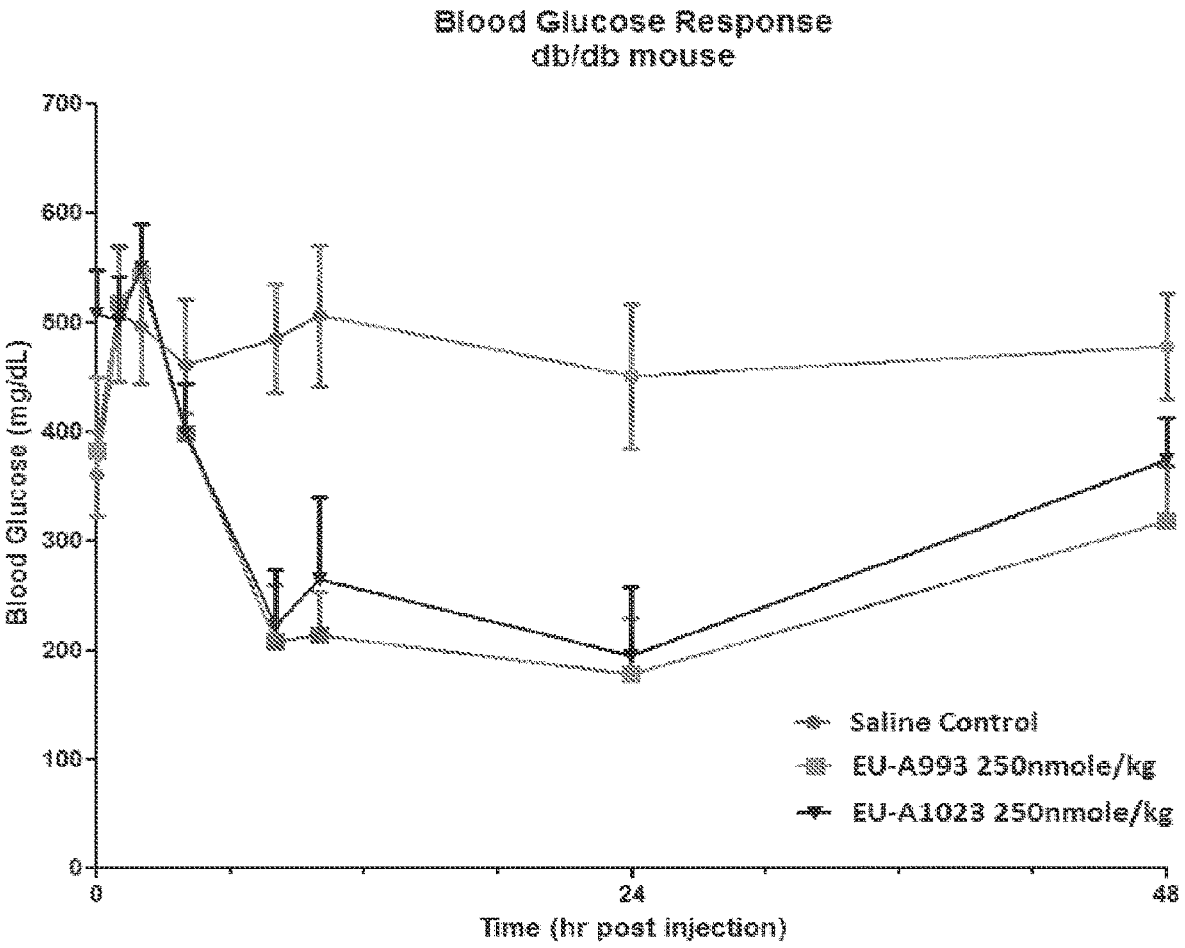
FIG. 5.
Figure 6:
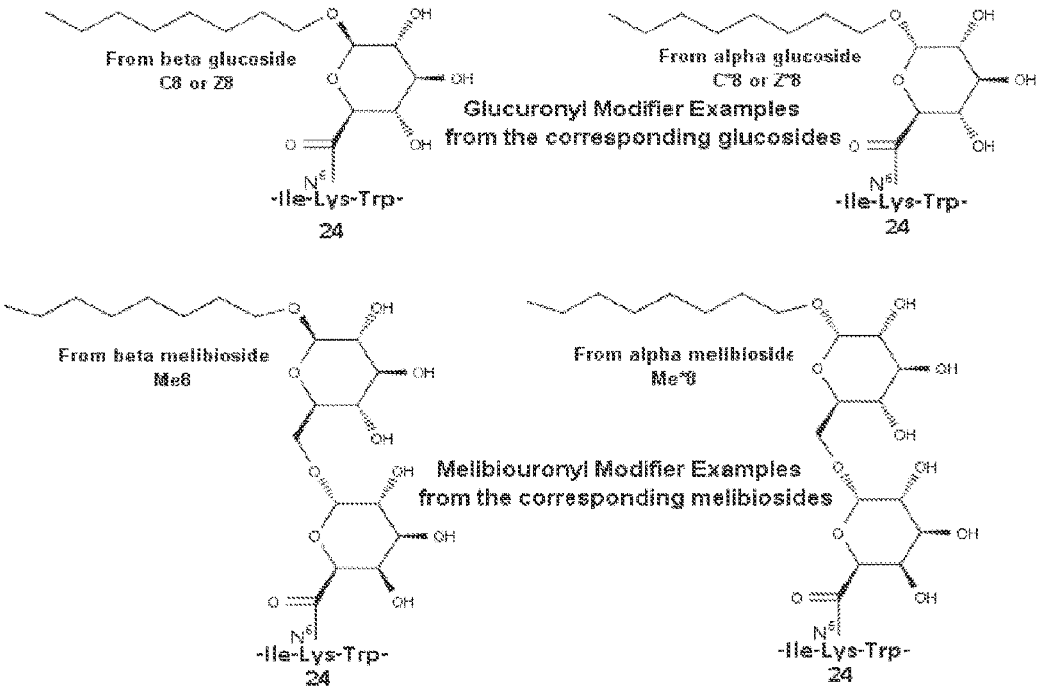
FIG. 6.
Figure 7:
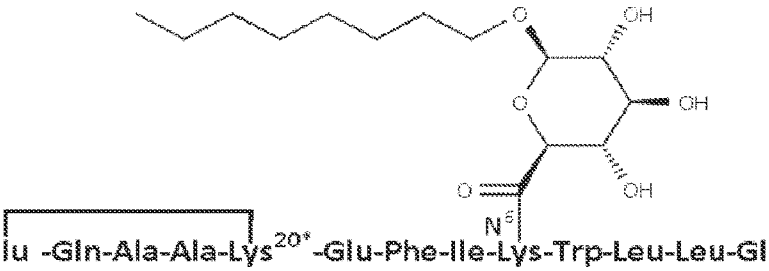
FIG. 7.

Significant body weight changes were noted against vehicle for liraglutide and high dose EU-A994 and high dose EU-A1026 on Days 2 and 3 and low dose EU-A1026 on Days 3 and 4. In the food consumption analysis, liraglutide-treated animals were significantly different from vehicle on Days 1 and 2, high dose EU-A994 at Day 1, low dose EU-A995 at Day 1 and 2, high dose EU-A994 at Day 1, and low and high dose of EU-A1026 at Day 2 were significantly different from Liraglutide. Glucose levels for Liraglutide at 10 hours and high dose EU-A994 at 10 and 24 hours were significantly different from vehicle. Low dose EU-A995 and EU-A1026 at 10 hours were significantly different from liraglutide (FIG. 5). In a like manner, other analogs from the series were tested for effects on blood glucose, body weight and food consumption.

| | Dose | db/db mice-Mean Blood Glucose (mg/dL) | | | |
|---|---|---|---|---|---|
| Compound | (nmole/kg) | 0 hr | 10 hr | 24 hr | 48 hr |
| liraglutide | 50 | 595 | 265 | 347 | 377 |
| EU-A994 | 300 | 554 | 242 | 209 | 385 |
| EU-A995 | 300 | 503 | 471 | 493 | 527 |
| EU-A1026 | 300 | 531 | 399 | 438 | 505 |
| liraglutide | 50 | 528 | 286 | 404 | 477 |
| EU-A993 | 250 | 503 | 305 | 324 | 426 |
| EU-A995 | 250 | 539 | 584 | 548 | 546 |
| EU-A1023 | 50 | 507 | 310 | 355 | 375 |
| EU-A1023 | 250 | 508 | 264 | 194 | 375 |
| liraglutide | 50 | 442 | 174 | 244 | 439 |
| EU-A992 | 250 | 405 | 104 | 112 | 130 |
| EU-A1167 | 250 | 379 | 171 | 117 | 113 |
| EU-A1168 | 250 | 380 | 133 | 169 | 164 |

Example 8: In Vivo Assay of Compounds—DIO Mice

Sixty (60) diet induced obese C57BL/6J male mice are received from JAX labs at 14 wks of age. The mice are ear notched for identification and housed in individually and positively ventilated polycarbonate cages with HEPA filtered air at density of one mouse per cage. The animal room is lighted entirely with artificial fluorescent lighting, with a controlled 12 h light/dark cycle. The normal temperature and relative humidity ranges in the animal rooms are 22±4° C. and 50±15%, respectively. Filtered tap water, acidified to a pH of 2.8 to 3.1, and high fat diet (60 kcal %) are provided ad libitum.

Following a 2 week acclimation, 40 mice are chosen based on desired body weight range and mice are randomized into groups (n=10) as below. Group 1. Vehicle treated; Group 2. Low dose test cmpd; Group 3. Mid dose test cmpd; Group 4. High dose test cmpd. Mice are dosed via SC daily for 28 days. Body weights and cage side observations are recorded daily. Food and water intake will be recorded weekly. Mice undergo NMR measurements for determining whole body fat and lean composition on days 1 (pre-dose) and 26. On days 0, 14 and 27, mice are fasted overnight for an oral glucose tolerance test. Next day, the first blood sample is collected via tail nick (t=0). Mice are then administered a bolus of 1.0 g/kg glucose. Blood samples are obtained via tail nick at 5, 30, 60 and 120 min after glucose and plasma glucose will be immediately determined using a glucometer.

Sacrifice and tissue collection: Mice are sacrificed on day 29. Terminal blood is processed to serum/plasma and aliquots are sent for analysis of glucose, insulin and lipid profile. Body composition is determined by NMR. The optimal compound profile shows decreased glucose excursion in the OGTT, decreased basal insulin secretion, with potentiated glucose-dependent insulin secretion, decreased weight gain, decreased fat mass but minimal effects on lean mass.

Example 9: Uses of the Compounds

The covalently modified peptides and/or proteins described herein are useful for the prevention and treatment of a variety of diseases related to obesity, the metabolic syndrome, cardiovascular disease and diabetes. Suitably labeled surfactant modified peptides can be used as diagnostic probes.

Representative delivery regimens include oral, parenteral (including subcutaneous, intramuscular and intravenous injection), rectal, buccal (including sublingual), transdermal, inhalation ocular and intranasal. An attractive and widely used method for delivery of peptides entails subcutaneous injection of a controlled release injectable formulation. Other administration routes for the application of the covalently modified peptides and/or proteins described herein are subcutaneous, intranasal and inhalation administration.

Example 10. Pharmaceutical Usage for Treatment of Insulin Resistance

A human patient, with evidence of insulin resistance or metabolic syndrome is treated with EU-A596 by intranasal administration (200 µL) from a standard atomizer used in the art of a solution of the pharmaceutical agent in physiological saline containing from 0.5 to 10 mg/mL of the pharmaceutical agent and containing standard excipients such as benzyl alcohol. The treatment is repeated as necessary for the alleviation of symptoms such as obesity, elevated blood glucose and the like. In a similar manner, a solution of EU-A596, and selected excipients, in an evaporating solvent containing such as a hydrofluoroalkane is administered intranasally by metered dose inhaler (MDI) as needed to reduce insulin resistance. The effect of treatment is determined using standard tests including measurement of blood glucose levels, HbA1c, Body Mass Index, and/or body weight and/or measurement of waist to hip ratios.

In a similar manner, administration of an adjusted amount by transbuccal, intravaginal, inhalation, subcutaneous, intravenous, intraocular, or oral routes is tested to determine level of stimulation of GLP1R and/or GLCR on cells in the body and to determine therapeutic effects.

SEQUENCES

The specification provides sequences for SEQ. ID. Nos. 1-3 and SEQ. ID. Nos. 774-783 and 785-797. Additionally, Table 1 of FIG. 1 provides SEQ. ID Numbers for compounds EU-A300 to EU-A425 having SEQ. ID. NOs. 4-129 respectively, as shown in Table 1 of FIG. 1. Compounds in Table 1 of FIG. 1, and their respective SEQ. ID. NOs. shown in Table 1 of FIG. 1 are hereby incorporated into the specification as filed. Additionally, Table 2 of FIG. 2 provides SEQ. ID Numbers for compounds EU-A426 to EU-599 having SEQ. ID. NOs. 130-317 respectively, as shown in Table 2 of FIG. 2. Compounds in Table 2 of FIG. 2, and their respective SEQ. ID. NOs. shown in Table 2 of FIG. 2 are hereby incorporated into the specification as filed. Additionally, Table 3 of FIG. 3 provides SEQ. ID Numbers for compounds EU-A700 to EU-A1174 having SEQ. ID. NOs. 318-773; 798-806 respectively, as shown in Table 3 of FIG. 3. Compounds in Table 3 of FIG. 3, and their respective SEQ. ID. NOs. shown in Table 3 of FIG. 3 are hereby incorporated into the specification as filed

SEQUENCE LISTING (819 sequences)

SEQ ID NO: 1 - protein, 37 aa, Synthetic construct
  MOD_RES 1: note = His, N-R4-His, pGlu-His, or N-R3-His
  MOD_RES 2: note = Ser, D-Ser, Ala, Gly, Pro, MePro, Aib, Ac4c, or Ac5c
  MOD_RES 3: note = Gln, or Cit
  MOD_RES 4: note = Gly, or D-Ala
  MOD_RES 5: note = Thr, or Ser
  MOD_RES 6: note = Phe, Trp, 2FPhe, MePhe, 2FMePhe, or Nal2
  MOD_RES 7: note = Thr, or Ser
  MOD_RES 8: note = Ser, or Asp
  MOD_RES 9: note = Asp, or Glu
  MOD_RES 10: note = Tyr, Leu, Met, Nal2, Bip, Bip2EtMeO or U
  MOD_RES 11: note = absent or Ser, Asn, Bip or U
  MOD_RES 12: note = absent or Lys, Glu, Ser, Arg, or U
  MOD_RES 13: note = absent or Tyr, Gln, Cit, or U
  MOD_RES 14: note = absent or Leu, Met, Nle, or U
  MOD_RES 15: note = absent or Asp, Glu, or U
  MOD_RES 16: note = absent or Ser, Gly, Glu, Ala, Aib, Ac5c, Lys, Arg, or U
  MOD_RES 17: note = absent or Arg, hArg, Gln, Glu, Cit, Aib, Ac4c, Ac5c, Lys, or U
  MOD_RES 18: note = absent or Arg, hArg, Ala, Aib, Ac4c, Ac5c, or U
  MOD_RES 19: note = absent or Ala, Val, Aib, Ac4c, Ac5c, or U
  MOD_RES 20: note = absent or Gln, Lys, Arg, Cit, Glu, Aib, Ac4c, Ac5c, or U
  MOD_RES 21: note = absent or Asp, Glu, Leu, Aib, Ac4c, Ac5c, or U
  MOD_RES 22: note = absent or Phe, Trp, Nal2, Aib, Ac4c, Ac5c, or U
  MOD_RES 23: note = absent or Val, Ile, Aib, Ac4c, Ac5c, or U
  MOD_RES 24: note = absent or Gln, Ala, Glu, Cit, or U
  MOD_RES 25: note = absent or Trp, Nal2, or U
  MOD_RES 26: note = absent or Leu, or U
  MOD_RES 27: note = absent or Met, Val, Leu, Nle, Lys, or U
  MOD_RES 28: note = absent or Asn, Lys, Gln, Cit, or U
  MOD_RES 29: note = absent or Thr, Gly, Aib, Ac4c, Ac5c, or U
  MOD_RES 30: note = absent or Lys, Aib, Ac4c, Ac5c, Arg, or U
  MOD_RES 31: note = absent or Arg, Aib, Ac4c, Ac5c, or U
  MOD_RES 32: note = absent or Asn, Aib, Ac4c, Ac5c, or U
  MOD_RES 33: note = absent or Asn, Aib, Ac4c, Ac5c, or U
  MOD_RES 34: note = absent or Asn, Aib, Ac4c, Ac5c, or U
  MOD_RES 35: note = absent or Asn, Aib, Ac4c, Ac5c, or U
  MOD_RES 36: note = absent or Ile, Ala, Aib, Ac4c, Ac5C, or U
  MOD_RES 37: note = absent or U
XXXXTXTSDXXXXXXXXXXXXXXXXXXXXXXXXXXXX

SEQ ID NO: 2 - protein, 29 aa, synthetic construct
  MOD_RES 29: note = absent or Thr, Gly, Aib, Ac4c, Ac5c, or U(X); wherein "U(X)" is a natural or unnatural amino acid comprising a functional group covalently attached to the surfactant X
  MOD_RES 28: note = absent or Asn, Lys, Gln, or U(X); wherein "U(X)" is a natural or unnatural amino acid comprising a functional group covalently attached to the surfactant X
  MOD_RES 27: note = absent or Met, Val, Leu, Nle, Lys, or U(X); wherein "U(X)" is a natural or unnatural amino acid comprising a functional group covalently attached to the surfactant X
  MOD_RES 26: note = absent or Leu, or U(X); wherein "U(X)" is a natural or unnatural amino acid comprising a functional group covalently attached to the surfactant X
  MOD_RES 25: note = absent or Trp, Nal2, or U(X); wherein "U(X)" is a natural or unnatural amino acid comprising a functional group covalently attached to the surfactant X
  MOD_RES 24: note = absent or Gln, Ala, Glu, Cit, or U(X); wherein "U(X)" is a natural or unnatural amino acid comprising a functional group covalently attached to the surfactant X
  MOD_RES 23: note = absent or Val, Ile, Aib, Ac4c, Ac5c, or U(X); wherein "U(X)" is a natural or unnatural amino acid comprising a functional group covalently attached to the surfactant X
  MOD_RES 22: note = absent or Phe, Trp, Nal2, Aib, Ac4c, Ac5c, or U(X); wherein "U(X)" is a natural or unnatural amino acid comprising a functional group covalently attached to the surfactant X
  MOD_RES 21: note = absent or Asp, Glu, Leu, Aib, Ac4c, Ac5c, or U(X); wherein "U(X)" is a natural or unnatural amino acid comprising a functional group covalently attached to the surfactant X
  MOD_RES 20: note = absent or Gln, Lys, Arg, Cit, Glu, Aib, Ac4c, Ac5c, or U(X); wherein "U(X)" is a natural or unnatural amino acid comprising a functional group covalently attached to the surfactant X
  MOD_RES 19: note = absent or Ala, Val, Aib, Ac4c, Ac5c, or U(X); wherein "U(X)" is a natural or unnatural amino acid comprising a functional group covalently attached to the surfactant X
  MOD_RES 18: note = absent or Arg, hArg, Ala, Aib, Ac4c, Ac5c, or U(X); wherein "U(X)" is a natural or unnatural amino acid comprising a functional group covalently attached to the surfactant X
  MOD_RES 17: note = absent or Arg, hArg, Gln, Glu, Lys, Cit, Aib, Ac4c, Ac5c, or U(X)
  MOD_RES 16: note = absent or Ser, Gly, Glu, Ala, Aib, Ac5c, Lys, Arg, or U(X); wherein "U(X)" is a natural or unnatural amino acid comprising a functional group covalently attached to the surfactant X
  MOD_RES 15: note = absent or Asp, Glu, or U(X); wherein "U(X)" is a natural or unnatural amino acid comprising a functional group covalently attached to the surfactant X
  MOD_RES 14: note = absent or Leu, Met, Nle, or U(X); wherein "U(X)" is a natural or unnatural amino acid comprising a functional group covalently attached to the surfactant X
  MOD_RES 13: note = absent or Tyr, Gln, Cit, or U(X); wherein "U(X)" is a natural or unnatural amino acid comprising a functional group covalently attached to the surfactant X
  MOD_RES 12: note = absent or Lys, Glu, Ser, Arg, or U(X); wherein "U(X)" is a natural or unnatural amino acid comprising a functional group covalently attached to the surfactant X
  MOD_RES 11: note = absent or Ser, Asn, Bip or U(X); wherein "U(X)" is a natural or unnatural amino acid comprising a functional group covalently attached to the surfactant X
  MOD_RES 10: note = Tyr, Leu, Met, Nal2, Bip, Bip2EtMeO or U(X); wherein "U(X)" is a natural or unnatural amino acid comprising a functional group covalently attached to the surfactant X
  MOD_RES 9: note = Asp, or Glu
  MOD_RES 8: note = Ser, or Asp
  MOD_RES 7: note = Thr, or Ser
  MOD_RES 6: note = Phe, Trp, 2FPhe, MePhe, 2FMePhe, or Nal2
  MOD_RES 5: note = Thr, or Ser
  MOD_RES 4: note = Gly, or D-Ala
  MOD_RES 3: note = Gln, or Cit
  MOD_RES 2: note = Ser, Ala, Gly, MePro, Aib, Ac4c, or Ac5c
  MOD_RES 1: note = His, N-Ac-His, pGlu-His, or N-R3-His
XXXXTXTSDXXXXXXXXXXXXXXXXXXXX

SEQ ID NO: 3 - protein, 30 aa, synthetic construct
  REGION 1..30: note = Synthetic polypeptide
  MOD_RES 2: note = Gly, MePro or Aib
  MOD_RES 3: note = Gln or Cit
  MOD_RES 6: note = Phe, 2FPhe, MePhe, 2FMePhe or Nal2
  MOD_RES 10: note = Tyr, Nal2, Bip, Bip2EtMeO or U(X); wherein "U(X)" is a natural or unnatural amino acid comprising a functional group covalently attached to the surfactant X
  MOD_RES 11: note = absent or Ser, Asn, Bip or U(X); wherein "U(X)" is a natural or unnatural amino acid comprising a functional group covalently attached to the surfactant X
  MOD_RES 12: note = absent or Lys, Glu, Ser or U(X); wherein "U(X)" is a natural or unnatural amino acid comprising a functional group covalently attached to the surfactant X
  MOD_RES 13: note = absent or Tyr, Gln, Cit or U(X); wherein "U(X)" is a natural or unnatural amino acid comprising a functional group covalently attached to the surfactant X
  MOD_RES 14: note = absent or Leu, Nle or U(X); wherein "U(X)" is a natural or unnatural amino acid comprising a functional group covalently attached to the surfactant X
  MOD_RES 15: note = absent or Asp, Glu or U(X); wherein "U(X)" is a natural or unnatural amino acid comprising a functional group covalently attached to the surfactant X
  MOD_RES 16: note = absent or Ser, Gly, Glu, Ala, Aib, Lys, Arg or U(X); wherein "U(X)" is a natural or unnatural amino acid comprising a functional group covalently attached to the surfactant X
  MOD_RES 17: note = absent or Arg, hArg, Gln, Glu, Lys, Cit, Aib or U(X); wherein "U(X)" is a natural or unnatural amino acid comprising a functional group covalently attached to the surfactant X
  MOD_RES 18: note = absent or Arg, hArg, Ala, Aib, Ac4c, Ac5c or U(X); wherein "U(X)" is a natural or unnatural amino acid comprising a functional group covalently attached to the surfactant X
  MOD_RES 19: note = absent or Ala, Aib or U(X); wherein "U(X)" is a natural or unnatural amino acid comprising a functional group covalently attached to the surfactant X
  MOD_RES 20: note = absent or Gln, Lys, Arg, Cit, Glu, Aib or U(X); wherein "U(X)" is a natural or unnatural amino acid comprising a functional group covalently attached to the surfactant X
  MOD_RES 21: note = absent or Asp, Glu, Leu, Aib or U(X); wherein "U(X)" is a natural or unnatural amino acid comprising a functional group covalently attached to the surfactant X
  MOD_RES 22: note = absent or Phe or U(X); wherein "U(X)" is a natural or unnatural amino acid comprising a functional group covalently attached to the surfactant X
  MOD_RES 23: note = absent or Val, Ile, Aib or U(X); wherein "U(X)" is a natural or unnatural amino acid comprising a functional group covalently attached to the surfactant X
  MOD_RES 24: note = absent or Ala, Gln or U(X); wherein "U(X)" is a natural or unnatural amino acid comprising a functional group covalently attached to the surfactant X
  MOD_RES 25: note = absent or Trp or U(X); wherein "U(X)" is a natural or unnatural amino acid comprising a functional group covalently attached to the surfactant X
  MOD_RES 26: note = absent or Leu or U(X); wherein "U(X)" is a natural or unnatural amino acid comprising a functional group covalently attached to the surfactant X
  MOD_RES 27: note = absent or Met, Val, Leu, Nle, Lys or U(X); wherein "U(X)" is a natural or unnatural amino acid comprising a functional group covalently attached to the surfactant X
  MOD_RES 28: note = absent or Asn, Gln, Cit or U(X); wherein "U(X)" is a natural or unnatural amino acid comprising a functional group covalently attached to the surfactant X
  MOD_RES 29: note = absent or Thr, Aib or U(X); wherein "U(X)" is a natural or unnatural amino acid comprising a functional group covalently attached to the surfactant X
  MOD_RES 30: note = absent or Arg or U(X); wherein "U(X)" is a natural or unnatural amino acid comprising a functional group covalently attached to the surfactant X and the terminal is -OH or -NH-R3.
  REGION 1..30: note = See specification as filed for detailed description of substitutions and preferred embodiments
HXXGTXTSDXXXXXXXXXXXXXXXXXXXXX

SEQ ID NO: 4 - protein, 11 aa, synthetic construct
  REGION 1..11: note = Synthetic peptide
  MOD_RES 2: note = Aib
  MOD_RES 11: note = Lys(C8)
  REGION 1..11: note = C-term amide
HXQGTFTSDLX

SEQ ID NO: 5 - protein, 11 aa, synthetic construct
  REGION 1..11: note = Synthetic peptide
  MOD_RES 2: note = Aib
  MOD_RES 11: note = Lys(C12)
  REGION 1..11: note = C-term amide
HXQGTFTSDLX

SEQ ID NO: 6 - protein, 11 aa, synthetic construct
  REGION 1..11: note = Synthetic peptide
  MOD_RES 2: note = Aib
  MOD_RES 11: note = Lys(C16)
  REGION 1..11: note = C-term amide
HXQGTFTSDLX

SEQ ID NO: 7 - protein, 11 aa, synthetic construct
  REGION 1..11: note = Synthetic peptide
  MOD_RES 2: note = Aib
  MOD_RES 10: note = Bip
  MOD_RES 11: note = Lys(C8)
  REGION 1..11: note = C-term amide
HXQGTFTSDXX

SEQ ID NO: 8 - protein, 11 aa, synthetic construct
  REGION 1..11: note = Synthetic peptide
  MOD_RES 2: note = Aib
  MOD_RES 10: note = Bip
  MOD_RES 11: note = Lys(C12)
  REGION 1..11: note = C-term amide
HXQGTFTSDXX

SEQ ID NO: 9 - protein, 11 aa, synthetic construct
  REGION 1..11: note = Synthetic peptide
  MOD_RES 2: note = Aib
  MOD_RES 10: note = Bip
  MOD_RES 11: note = Lys(C16)
  REGION 1..11: note = C-term amide
HXQGTFTSDXX

SEQ ID NO: 10 - protein, 11 aa, synthetic construct
  REGION 1..11: note = Synthetic peptide
  MOD_RES 2: note = Aib
  MOD_RES 10: note = Nal(2)
  MOD_RES 11: note = Lys(C8)
  REGION 1..11: note = C-term amide
HXQGTFTSDXX

SEQ ID NO: 11 - protein, 11 aa, synthetic construct
  REGION 1..11: note = Synthetic peptide
  MOD_RES 2: note = Aib
  MOD_RES 10: note = Nal(2)
  MOD_RES 11: note = Lys(C12)
  REGION 1..11: note = C-term amide
HXQGTFTSDXX

SEQ ID NO: 12 - protein, 11 aa, synthetic construct
  REGION 1..11: note = Synthetic peptide
  MOD_RES 2: note = Aib
  MOD_RES 10: note = Nal(2)
  MOD_RES 11: note = Lys(C16)
  REGION 1..11: note = C-term amide
HXQGTFTSDXX

SEQ ID NO: 13 - protein, 11 aa, synthetic construct
  REGION 1..11: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 11: note = Lys(C8)
  REGION 1..11: note = C-term amide
HXQGTXTSDXX

SEQ ID NO: 14 - protein, 11 aa, synthetic construct
  REGION 1..11: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 11: note = Lys(C12)
  REGION 1..11: note = C-term amide
HXQGTXTSDXX

SEQ ID NO: 15 - protein, 11 aa, synthetic construct
  REGION 1..11: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 11: note = Lys(C16)
  REGION 1..11: note = C-term amide
HXQGTXTSDXX

SEQ ID NO: 16 - protein, 15 aa, synthetic construct
  REGION 1..15: note = Synthetic peptide
  MOD_RES 2: note = Aib
  MOD_RES 15: note = Lys(C8)
  REGION 1..15: note = C-term amide
HXQGTFTSDLSKYLX

SEQ ID NO: 17 - protein, 15 aa, synthetic construct
  REGION 1..15: note = Synthetic peptide
  MOD_RES 2: note = Aib
  MOD_RES 15: note = Lys(C12)
  REGION 1..15: note = C-term amide
HXQGTFTSDLSKYLX

SEQ ID NO: 18 - protein, 15 aa, synthetic construct
  REGION 1..15: note = Synthetic peptide
  MOD_RES 2: note = Aib
  MOD_RES 15: note = Lys(C16)
  REGION 1..15: note = C-term amide
HXQGTFTSDLSKYLX

SEQ ID NO: 19 - protein, 15 aa, synthetic construct
  REGION 1..15: note = Synthetic peptide
  MOD_RES 2: note = Aib
  MOD_RES 10: note = Bip
  MOD_RES 15: note = Lys(C8)
  REGION 1..15: note = C-term amide
HXQGTFTSDXSKYLX

SEQ ID NO: 20 - protein, 15 aa, synthetic construct
  REGION 1..15: note = Synthetic peptide
  MOD_RES 2: note = Aib
  MOD_RES 10: note = Bip
  MOD_RES 15: note = Lys(C12)
  REGION 1..15: note = C-term amide
HXQGTFTSDXSKYLX

SEQ ID NO: 21 - protein, 15 aa, synthetic construct
  REGION 1..15: note = Synthetic peptide
  MOD_RES 2: note = Aib
  MOD_RES 10: note = Bip
  MOD_RES 15: note = Lys(C16)
  REGION 1..15: note = C-term amide
HXQGTFTSDXSKYLX

SEQ ID NO: 22 - protein, 15 aa, synthetic construct
  REGION 1..15: note = Synthetic peptide
  MOD_RES 2: note = Aib
  MOD_RES 10: note = Nal(2)
  MOD_RES 15: note = Lys(C8)
  REGION 1..15: note = C-term amide
HXQGTFTSDXSKYLX

SEQ ID NO: 23 - protein, 15 aa, synthetic construct
  REGION 1..15: note = Synthetic peptide
  MOD_RES 2: note = Aib
  MOD_RES 10: note = Nal(2)
  MOD_RES 15: note = Lys(C12)
  REGION 1..15: note = C-term amide
HXQGTFTSDXSKYLX

SEQ ID NO: 24 - protein, 15 aa, synthetic construct
  REGION 1..15: note = Synthetic peptide
  MOD_RES 2: note = Aib
  MOD_RES 10: note = Nal(2)
  MOD_RES 15: note = Lys(C16)
  REGION 1..15: note = C-term amide
HXQGTFTSDXSKYLX

SEQ ID NO: 25 - protein, 15 aa, synthetic construct
  REGION 1..15: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 15: note = Lys(C8)
  REGION 1..15: note = C-term amide
HXQGTXTSDXSKYLX

SEQ ID NO: 26 - protein, 15 aa, synthetic construct
  REGION 1..15: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 15: note = Lys(C12)
  REGION 1..15: note = C-term amide
HXQGTXTSDXSKYLX

SEQ ID NO: 27 - protein, 15 aa, synthetic construct
  REGION 1..15: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 15: note = Lys(C16)
  REGION 1..15: note = C-term amide
HXQGTXTSDXSKYLX

SEQ ID NO: 28 - protein, 18 aa, synthetic construct
  REGION 1..18: note = Synthetic peptide
  MOD_RES 2: note = Aib
  MOD_RES 18: note = Lys(C8)
  REGION 1..18: note = C-term amide
HXQGTFTSDVSKYLDGRX

SEQ ID NO: 29 - protein, 18 aa, synthetic construct
  REGION 1..18: note = Synthetic peptide
  MOD_RES 2: note = Aib
  MOD_RES 18: note = Lys(C8)
  REGION 1..18: note = C-term amide
HXQGTFTSDLSKYLDGRX

SEQ ID NO: 30 - protein, 18 aa, synthetic construct
  REGION 1..18: note = Synthetic peptide
  MOD_RES 2: note = Aib
  MOD_RES 18: note = Lys(C12)
  REGION 1..18: note = C-term amide
HXQGTFTSDLSKYLDGRX

SEQ ID NO: 31 - protein, 18 aa, synthetic construct
  REGION 1..18: note = Synthetic peptide
  MOD_RES 2: note = Aib
  MOD_RES 18: note = Lys(C16)
  REGION 1..18: note = C-term amide
HXQGTFTSDLSKYLDGRX

SEQ ID NO: 32 - protein, 18 aa, synthetic construct
  REGION 1..18: note = Synthetic peptide
  MOD_RES 2: note = Aib
  MOD_RES 10: note = Bip
  MOD_RES 18: note = Lys(C8)
  REGION 1..18: note = C-term amide
HXQGTFTSDXSKYLDGRX

SEQ ID NO: 33 - protein, 18 aa, synthetic construct
  REGION 1..18: note = Synthetic peptide
  MOD_RES 2: note = Aib
  MOD_RES 10: note = Bip
  MOD_RES 18: note = Lys(C12)
  REGION 1..18: note = C-term amide
HXQGTFTSDXSKYLDGRX

SEQ ID NO: 34 - protein, 18 aa, synthetic construct
  REGION 1..18: note = Synthetic peptide
  MOD_RES 2: note = Aib
  MOD_RES 10: note = Bip
  MOD_RES 18: note = Lys(C16)
  REGION 1..18: note = C-term amide
HXQGTFTSDXSKYLDGRX

SEQ ID NO: 35 - protein, 18 aa, synthetic construct
  REGION 1..18: note = Synthetic peptide
  MOD_RES 2: note = Aib
  MOD_RES 10: note = Nal(2)
  MOD_RES 18: note = Lys(C8)
  REGION 1..18: note = C-term amide
HXQGTFTSDXSKYLDGRX

SEQ ID NO: 36 - protein, 18 aa, synthetic construct
  REGION 1..18: note = Synthetic peptide
  MOD_RES 2: note = Aib
  MOD_RES 10: note = Nal(2)
  MOD_RES 18: note = Lys(C12)
  REGION 1..18: note = C-term amide
HXQGTFTSDXSKYLDGRX

SEQ ID NO: 37 - protein, 18 aa, synthetic construct
  REGION 1..18: note = Synthetic peptide
  MOD_RES 2: note = Aib
  MOD_RES 10: note = Nal(2)
  MOD_RES 18: note = Lys(C16)
  REGION 1..18: note = C-term amide
HXQGTFTSDXSKYLDGRX

SEQ ID NO: 38 - protein, 18 aa, synthetic construct
  REGION 1..18: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 18: note = Lys(C8)
  REGION 1..18: note = C-term amide
HXQGTXTSDXSKYLDGRX

SEQ ID NO: 39 - protein, 18 aa, synthetic construct
  REGION 1..18: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 18: note = Lys(C12)
  REGION 1..18: note = C-term amide
HXQGTXTSDXSKYLDGRX

SEQ ID NO: 40 - protein, 18 aa, synthetic construct
  REGION 1..18: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 18: note = Lys(C16)
  REGION 1..18: note = C-term amide
HXQGTXTSDXSKYLDGRX

SEQ ID NO: 41 - protein, 11 aa, synthetic construct
  REGION 1..11: note = Synthetic peptide
  MOD_RES 2: note = Aib
  MOD_RES 11: note = Lys(C8)
  REGION 1..11: note = C-term amide
HXQGTFTSDLX

SEQ ID NO: 42 - protein, 11 aa, synthetic construct
  REGION 1..11: note = Synthetic peptide
  MOD_RES 2: note = Aib
  MOD_RES 11: note = Lys(C12)
  REGION 1..11: note = C-term amide
HXQGTFTSDLX

SEQ ID NO: 43 - protein, 11 aa, synthetic construct
  REGION 1..11: note = Synthetic peptide
  MOD_RES 2: note = Aib
  MOD_RES 11: note = Lys(C16)
  REGION 1..11: note = C-term amide
HXQGTFTSDLX

SEQ ID NO: 44 - protein, 11 aa, synthetic construct
  REGION 1..11: note = Synthetic peptide
  MOD_RES 2: note = Aib
  MOD_RES 10: note = Bip
  MOD_RES 11: note = Lys(C8)
  REGION 1..11: note = C-term amide
HXQGTFTSDXX

SEQ ID NO: 45 - protein, 11 aa, synthetic construct
  REGION 1..11: note = Synthetic peptide
  MOD_RES 2: note = Aib
  MOD_RES 10: note = Bip
  MOD_RES 11: note = Lys(C12)
  REGION 1..11: note = C-term amide
HXQGTFTSDXX

SEQ ID NO: 46 - protein, 11 aa, synthetic construct
  REGION 1..11: note = Synthetic peptide
  MOD_RES 2: note = Aib
  MOD_RES 10: note = Bip
  MOD_RES 11: note = Lys(C16)
  REGION 1..11: note = C-term amide
HXQGTFTSDXX

SEQ ID NO: 47 - protein, 11 aa, synthetic construct
  REGION 1..11: note = Synthetic peptide
  MOD_RES 2: note = Aib
  MOD_RES 10: note = Nal(2)
  MOD_RES 11: note = Lys(C8)
  REGION 1..11: note = C-term amide
HXQGTFTSDXX

SEQ ID NO: 48 - protein, 11 aa, synthetic construct
  REGION 1..11: note = Synthetic peptide
  MOD_RES 2: note = Aib
  MOD_RES 10: note = Nal(2)
  MOD_RES 11: note = Lys(C12)
  REGION 1..11: note = C-term amide
HXQGTFTSDXX

SEQ ID NO: 49 - protein, 11 aa, synthetic construct
  REGION 1..11: note = Synthetic peptide
  MOD_RES 2: note = Aib
  MOD_RES 10: note = Nal(2)
  MOD_RES 11: note = Lys(C16)
  REGION 1..11: note = C-term amide
HXQGTFTSDXX

SEQ ID NO: 50 - protein, 11 aa, synthetic construct
  REGION 1..11: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 11: note = Lys(C8)
  REGION 1..11: note = C-term amide
HXQGTXTSDXX

SEQ ID NO: 51 - protein, 11 aa, synthetic construct
  REGION 1..11: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 11: note = Lys(C12)
  REGION 1..11: note = C-term amide
HXQGTXTSDXX

SEQ ID NO: 52 - protein, 11 aa, synthetic construct
  REGION 1..11: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 11: note = Lys(C16)
  REGION 1..11: note = C-term amide
HXQGTXTSDXX

SEQ ID NO: 53 - protein, 11 aa, synthetic construct
  REGION 1..11: note = Synthetic peptide
  MOD_RES 2: note = Aib
  MOD_RES 6: note = 2,6C-alphaMe-Phe
  MOD_RES 10: note = Bip
  MOD_RES 11: note = Lys(C8)
  REGION 1..11: note = C-term amide
HXQGTXTSDXX

SEQ ID NO: 54 - protein, 11 aa, synthetic construct
  REGION 1..11: note = Synthetic peptide
  MOD_RES 2: note = Aib
  MOD_RES 6: note = 2,6C-alphaMe-Phe
  MOD_RES 10: note = Bip
  MOD_RES 11: note = Lys(C12)
  REGION 1..11: note = C-term amide
HXQGTXTSDXX

SEQ ID NO: 55 - protein, 11 aa, synthetic construct
  REGION 1..11: note = Synthetic peptide
  MOD_RES 2: note = Aib
  MOD_RES 6: note = 2,6C-alphaMe-Phe
  MOD_RES 10: note = Bip
  MOD_RES 11: note = Lys(C16)
  REGION 1..11: note = C-term amide
HXQGTXTSDXX

SEQ ID NO: 56 - protein, 15 aa, synthetic construct
  REGION 1..15: note = Synthetic peptide
  MOD_RES 2: note = Aib
  MOD_RES 6: note = C-alphaMe-Phe
  MOD_RES 15: note = Lys(C8)
  REGION 1..15: note = C-term amide
HXQGTXTSDLSKYLX

SEQ ID NO: 57 - protein, 15 aa, synthetic construct
  REGION 1..15: note = Synthetic peptide
  MOD_RES 2: note = Aib
  MOD_RES 6: note = C-alphaC-alphaMe-Phe
  MOD_RES 15: note = Lys(C12)
  REGION 1..15: note = C-term amide
HXQGTXTSDLSKYLX

SEQ ID NO: 58 - protein, 15 aa, synthetic construct
  REGION 1..15: note = Synthetic peptide
  MOD_RES 2: note = Aib
  MOD_RES 6: note = C-alphaC-alphaMe-Phe
  MOD_RES 15: note = Lys(C16)
  REGION 1..15: note = C-term amide
HXQGTXTSDLSKYLX

SEQ ID NO: 59 - protein, 15 aa, synthetic construct
  REGION 1..15: note = Synthetic peptide
  MOD_RES 2: note = Aib
  MOD_RES 6: note = C-alphaMe-Phe
  MOD_RES 10: note = Bip
  MOD_RES 15: note = Lys(C8)
  REGION 1..15: note = C-term amide
HXQGTXTSDXSKYLX

SEQ ID NO: 60 - protein, 15 aa, synthetic construct
  REGION 1..15: note = Synthetic peptide
  MOD_RES 2: note = Aib
  MOD_RES 6: note = C-alphaMe-Phe
  MOD_RES 10: note = Bip
  MOD_RES 15: note = Lys(C12)
  REGION 1..15: note = C-term amide
HXQGTXTSDXSKYLX

SEQ ID NO: 61 - protein, 15 aa, synthetic construct
  REGION 1..15: note = Synthetic peptide
  MOD_RES 2: note = Aib
  MOD_RES 6: note = C-alphaMe-Phe
  MOD_RES 10: note = Bip
  MOD_RES 15: note = Lys(C16)
  REGION 1..15: note = C-term amide
HXQGTXTSDXSKYLX

SEQ ID NO: 62 - protein, 15 aa, synthetic construct
  REGION 1..15: note = Synthetic peptide
  MOD_RES 2: note = Aib
  MOD_RES 6: note = C-alphaMe-Phe
  MOD_RES 10: note = Nal(2)
  MOD_RES 15: note = Lys(C8)
  REGION 1..15: note = C-term amide
HXQGTXTSDXSKYLX

SEQ ID NO: 63 - protein, 15 aa, synthetic construct
  REGION 1..15: note = Synthetic peptide
  MOD_RES 2: note = Aib
  MOD_RES 6: note = C-alphaMe-Phe
  MOD_RES 10: note = Nal(2)
  MOD_RES 15: note = Lys(C12)
  REGION 1..15: note = C-term amide
HXQGTXTSDXSKYLX

SEQ ID NO: 64 - protein, 15 aa, synthetic construct
  REGION 1..15: note = Synthetic peptide
  MOD_RES 2: note = Aib
  MOD_RES 6: note = C-alphaMe-Phe
  MOD_RES 10: note = Nal(2)
  MOD_RES 15: note = Lys(C16)
  REGION 1..15: note = C-term amide
HXQGTXTSDXSKYLX

SEQ ID NO: 65 - protein, 15 aa, synthetic construct
  REGION 1..15: note = Synthetic peptide
  MOD_RES 2: note = Aib
  MOD_RES 6: note = C-alphaMe-Phe
  MOD_RES 10: note = 2'-ethyl-4'-MeO-biphenylalanine
  MOD_RES 15: note = Lys(C8)
  REGION 1..15: note = C-term amide
HXQGTXTSDXSKYLX

SEQ ID NO: 66 - protein, 15 aa, synthetic construct
  REGION 1..15: note = Synthetic peptide
  MOD_RES 2: note = Aib
  MOD_RES 6: note = C-alphaMe-Phe
  MOD_RES 10: note = 2'-ethyl-4'-MeO-biphenylalanine
  MOD_RES 15: note = Lys(C12)
  REGION 1..15: note = C-term amide
HXQGTXTSDXSKYLX

SEQ ID NO: 67 - protein, 15 aa, synthetic construct
  REGION 1..15: note = Synthetic peptide
  MOD_RES 2: note = Aib
  MOD_RES 6: note = C-alphaMe-Phe
  MOD_RES 10: note = 2'-ethyl-4'-MeO-biphenylalanine
  MOD_RES 15: note = Lys(C16)
  REGION 1..15: note = C-term amide
HXQGTXTSDXSKYLX

SEQ ID NO: 68 - protein, 17 aa, synthetic construct
  REGION 1..17: note = Synthetic peptide
  MOD_RES 2: note = Aib
  MOD_RES 17: note = Lys(C8)
  REGION 1..17: note = C-term amide
HXQGTFTSDVSKYLESX

SEQ ID NO: 69 - protein, 17 aa, synthetic construct
  REGION 1..17: note = Synthetic peptide
  MOD_RES 2: note = Aib
  MOD_RES 17: note = Lys(C8)
  REGION 1..17: note = C-term amide
HXQGTFTSDLSKYLESX

SEQ ID NO: 70 - protein, 17 aa, synthetic construct
  REGION 1..17: note = Synthetic peptide
  MOD_RES 2: note = Aib
  MOD_RES 17: note = Lys(C12)
  REGION 1..17: note = C-term amide
HXQGTFTSDLSKYLESX

SEQ ID NO: 71 - protein, 17 aa, synthetic construct
  REGION 1..17: note = Synthetic peptide
  MOD_RES 2: note = Aib
  MOD_RES 17: note = Lys(C16)
  REGION 1..17: note = C-term amide
HXQGTFTSDLSKYLESX

SEQ ID NO: 72 - protein, 17 aa, synthetic construct
  REGION 1..17: note = Synthetic peptide
  MOD_RES 2: note = Aib
  MOD_RES 10: note = Bip
  MOD_RES 17: note = Lys(C8)
  REGION 1..17: note = C-term amide
HXQGTFTSDXSKYLESX

SEQ ID NO: 73 - protein, 17 aa, synthetic construct
  REGION 1..17: note = Synthetic peptide
  MOD_RES 2: note = Aib
  MOD_RES 10: note = Bip
  MOD_RES 17: note = Lys(C12)
  REGION 1..17: note = C-term amide
HXQGTFTSDXSKYLESX

SEQ ID NO: 74 - protein, 17 aa, synthetic construct
  REGION 1..17: note = Synthetic peptide
  MOD_RES 2: note = Aib
  MOD_RES 10: note = Bip
  MOD_RES 17: note = Lys(C16)
  REGION 1..17: note = C-term amide
HXQGTFTSDXSKYLESX

SEQ ID NO: 75 - protein, 17 aa, synthetic construct
  REGION 1..17: note = Synthetic peptide
  MOD_RES 2: note = Aib
  MOD_RES 10: note = Nal(2)
  MOD_RES 17: note = Lys(C8)
  REGION 1..17: note = C-term amide
HXQGTFTSDXSKYLESX

SEQ ID NO: 76 - protein, 17 aa, synthetic construct
  REGION 1..17: note = Synthetic peptide
  MOD_RES 2: note = Aib
  MOD_RES 10: note = Nal(2)
  MOD_RES 17: note = Lys(C12)
  REGION 1..17: note = C-term amide
HXQGTFTSDXSKYLESX

SEQ ID NO: 77 - protein, 17 aa, synthetic construct
  REGION 1..17: note = Synthetic peptide
  MOD_RES 2: note = Aib
  MOD_RES 10: note = Nal(2)
  MOD_RES 17: note = Lys(C16)
  REGION 1..17: note = C-term amide
HXQGTFTSDXSKYLESX

SEQ ID NO: 78 - protein, 17 aa, synthetic construct
  REGION 1..17: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 17: note = Lys(C8)
  REGION 1..17: note = C-term amide
HXQGTXTSDXSKYLESX

SEQ ID NO: 79 - protein, 17 aa, synthetic construct
  REGION 1..17: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 17: note = Lys(C12)
  REGION 1..17: note = C-term amide
HXQGTXTSDXSKYLESX

SEQ ID NO: 80 - protein, 17 aa, synthetic construct
  REGION 1..17: note = Synthetic peptide
  MOD_RES 2: note = Aib
  MOD_RES 6: note = 2',6'-difluoro-Phe
  MOD_RES 10: note = 2'-ethyl-4'-MeO-biphenylalanine
  MOD_RES 17: note = Lys(C16)
  REGION 1..17: note = C-term amide
HXQGTXTSDXSKYLESX

SEQ ID NO: 81 - protein, 17 aa, synthetic construct
  REGION 1..17: note = Synthetic peptide
  MOD_RES 2: note = Aib
  MOD_RES 10: note = Bip
  MOD_RES 17: note = Lys(C8)
  REGION 1..17: note = C-term amide
HXQGTFTSDXSKYLDSX

SEQ ID NO: 82 - protein, 17 aa, synthetic construct
  REGION 1..17: note = Synthetic peptide
  MOD_RES 2: note = Aib
  MOD_RES 10: note = Bip
  MOD_RES 17: note = Lys(C12)
  REGION 1..17: note = C-term amide
HXQGTFTSDXSKYLDSX

SEQ ID NO: 83 - protein, 17 aa, synthetic construct
  REGION 1..17: note = Synthetic peptide
  MOD_RES 2: note = Aib
  MOD_RES 10: note = Bip
  MOD_RES 17: note = Lys(C16)
  REGION 1..17: note = C-term amide
HXQGTFTSDXSKYLDSX

SEQ ID NO: 84 - protein, 17 aa, synthetic construct
  REGION 1..17: note = Synthetic peptide
  MOD_RES 2: note = Aib
  MOD_RES 10: note = Bip
  MOD_RES 17: note = Lys(C8)
  REGION 1..17: note = C-term amide
HXQGTFTSDXSKYLDRX

SEQ ID NO: 85 - protein, 17 aa, synthetic construct
  REGION 1..17: note = Synthetic peptide
  MOD_RES 2: note = Aib
  MOD_RES 10: note = Bip
  MOD_RES 17: note = Lys(C12)
  REGION 1..17: note = C-term amide
HXQGTFTSDXSKYLDRX

SEQ ID NO: 86 - protein, 17 aa, synthetic construct
  REGION 1..17: note = Synthetic peptide
  MOD_RES 2: note = Aib
  MOD_RES 10: note = Bip
  MOD_RES 17: note = Lys(C16)
  REGION 1..17: note = C-term amide
HXQGTFTSDXSKYLDRX

SEQ ID NO: 87 - protein, 17 aa, synthetic construct
  REGION 1..17: note = Synthetic peptide
  MOD_RES 2: note = Aib
  MOD_RES 17: note = Lys(C8)
  REGION 1..17: note = C-term amide
HXQGTFTSDYSKYLDRX

SEQ ID NO: 88 - protein, 17 aa, synthetic construct
  REGION 1..17: note = Synthetic peptide
  MOD_RES 2: note = Aib
  MOD_RES 17: note = Lys(C12)
  REGION 1..17: note = C-term amide
HXQGTFTSDYSKYLDRX

SEQ ID NO: 89 - protein, 17 aa, synthetic construct
  REGION 1..17: note = Synthetic peptide
  MOD_RES 2: note = Aib
  MOD_RES 17: note = Lys(C16)
  REGION 1..17: note = C-term amide
HXQGTFTSDYSKYLDRX

SEQ ID NO: 90 - protein, 17 aa, synthetic construct
  REGION 1..17: note = Synthetic peptide
  MOD_RES 2: note = Aib
  MOD_RES 16: note = hArg
  MOD_RES 17: note = Lys(C12)
  REGION 1..17: note = C-term amide
HXQGTFTSDYSKYLDRX

SEQ ID NO: 91 - protein, 17 aa, synthetic construct
  REGION 1..17: note = Synthetic peptide
  MOD_RES 2: note = Aib
  MOD_RES 10: note = Bip
  MOD_RES 17: note = Lys(C12)
  REGION 1..17: note = C-term amide
HXQGTFTSDXSKYLESX

SEQ ID NO: 92 - protein, 17 aa, synthetic construct
  REGION 1..17: note = Synthetic peptide
  MOD_RES 2: note = Aib
  MOD_RES 6: note = C-alphaMe-Phe
  MOD_RES 10: note = Bip
  MOD_RES 17: note = Lys(C12)
  REGION 1..17: note = C-term amide
HXQGTXTSDXSKYLESX

SEQ ID NO: 93 - protein, 17 aa, synthetic construct
  REGION 1..17: note = Synthetic peptide
  MOD_RES 2: note = Aib
  MOD_RES 6: note = C-alphaMe-Phe
  MOD_RES 10: note = Bip
  MOD_RES 12: note = Aib
  MOD_RES 17: note = Lys(C12)
  REGION 1..17: note = C-term amide
HXQGTXTSDXSXYLESX

SEQ ID NO: 94 - protein, 17 aa, synthetic construct
  REGION 1..17: note = Synthetic peptide
  MOD_RES 2: note = Aib
  MOD_RES 6: note = C-alphaMe-Phe
  MOD_RES 10: note = Bip
  MOD_RES 16: note = Aib
  MOD_RES 17: note = Lys(C12)
  REGION 1..17: note = C-term amide
HXQGTXTSDXSKYLEXX

SEQ ID NO: 95 - protein, 17 aa, synthetic construct
  REGION 1..17: note = Synthetic peptide
  MOD_RES 2: note = Aib
  MOD_RES 6: note = C-alphaMe-Phe
  MOD_RES 16: note = Aib
  MOD_RES 17: note = Lys(C12)
  REGION 1..17: note = C-term amide
HXQGTXTSDYSKYLDXX

SEQ ID NO: 96 - protein, 17 aa, synthetic construct
  REGION 1..17: note = Synthetic peptide
  MOD_RES 2: note = Aib
  MOD_RES 6: note = C-alphaMe-Phe
  MOD_RES 11: note = Aib
  MOD_RES 16: note = Aib
  MOD_RES 17: note = Lys(C12)
  REGION 1..17: note = C-term amide
HXQGTXTSDYXKYLDXX

SEQ ID NO: 97 - protein, 12 aa, synthetic construct
  REGION 1..12: note = Synthetic peptide
  MOD_RES 2: note = Aib
  MOD_RES 6: note = C-alphaMe-Phe
  MOD_RES 11: note = Aib
  MOD_RES 12: note = Lys(C12)
  REGION 1..12: note = C-term amide
HXQGTXTSDYXX

SEQ ID NO: 98 - protein, 12 aa, synthetic construct
  REGION 1..12: note = Synthetic peptide
  MOD_RES 2: note = Aib
  MOD_RES 6: note = C-alphaMe-Phe
  MOD_RES 10: note = Nal(2)
  MOD_RES 11: note = Aib
  MOD_RES 12: note = Lys(C12)
  REGION 1..12: note = C-term amide
HXQGTXTSDXXX

SEQ ID NO: 99 - protein, 18 aa, synthetic construct
  REGION 1..18: note = Synthetic peptide
  MOD_RES 2: note = Aib
  MOD_RES 6: note = C-alphaMe-Phe
  MOD_RES 16: note = Aib
  MOD_RES 17: note = Lys(C12)
  MOD_RES 18: note = Aib
  REGION 1..18: note = C-term amide
HXQGTXTSDYSKYLDXXX

SEQ ID NO: 100 - protein, 18 aa, synthetic construct
  REGION 1..18: note = Synthetic peptide
  MOD_RES 2: note = Aib
  MOD_RES 6: note = C-alphaMe-Phe
  MOD_RES 10: note = Nal(2)
  MOD_RES 16: note = Aib
  MOD_RES 17: note = Lys(C12)
  MOD_RES 18: note = Aib
  REGION 1..18: note = C-term amide
HXQGTXTSDXSKYLDXXX

SEQ ID NO: 101 - protein, 17 aa, synthetic construct
  REGION 1..17: note = Synthetic peptide
  MOD_RES 2: note = Aib
  MOD_RES 6: note = C-alphaMe-Phe
  MOD_RES 11: note = Aib
  MOD_RES 16: note = Aib
  MOD_RES 17: note = Lys(C12)
  REGION 1..17: note = C-term amide
HXQGTXTSDYXKYLDXX

SEQ ID NO: 102 - protein, 18 aa, synthetic construct
  REGION 1..18: note = Synthetic peptide
  MOD_RES 2: note = Aib
  MOD_RES 6: note = C-alphaMe-Phe
  MOD_RES 11: note = Aib
  MOD_RES 16: note = Aib
  MOD_RES 17: note = Lys(C12)
  MOD_RES 18: note = Aib
  REGION 1..18: note = C-term amide
HXQGTXTSDYXKYLDXXX

SEQ ID NO: 103 - protein, 18 aa, synthetic construct
  REGION 1..18: note = Synthetic peptide
  MOD_RES 2: note = Aib
  MOD_RES 6: note = C-alphaMe-Phe
  MOD_RES 16: note = Aib
  MOD_RES 17: note = Lys(C12)
  MOD_RES 18: note = Aib
  REGION 1..18: note = C-term amide
HXQGTXTSDYSKYLDXXX

SEQ ID NO: 104 - protein, 19 aa, synthetic construct
  REGION 1..19: note = Synthetic peptide
  MOD_RES 2: note = Aib
  MOD_RES 6: note = C-alphaMe-Phe
  MOD_RES 17: note = Aib
  MOD_RES 18: note = Lys(C12)
  MOD_RES 19: note = Aib
  REGION 1..19: note = C-term amide
HXQGTXTSDYSKYLDRXXX

SEQ ID NO: 105 - protein, 19 aa, synthetic construct
  REGION 1..19: note = Synthetic peptide
  MOD_RES 2: note = Aib
  MOD_RES 6: note = C-alphaMe-Phe
  MOD_RES 11: note = Aib
  MOD_RES 17: note = Aib
  MOD_RES 18: note = Lys(C12)
  MOD_RES 19: note = Aib
  REGION 1..19: note = C-term amide
HXQGTXTSDYXKYLDRXXX

SEQ ID NO: 106 - protein, 19 aa, synthetic construct
  REGION 1..19: note = Synthetic peptide
  MOD_RES 2: note = Aib
  MOD_RES 6: note = C-alphaMe-Phe
  MOD_RES 11: note = Aib
  MOD_RES 17: note = Aib
  MOD_RES 18: note = Lys(C12)
  MOD_RES 19: note = Ac5c
  REGION 1..19: note = C-term amide
HXQGTXTSDYXKYLDRXXX

SEQ ID NO: 107 - protein, 18 aa, synthetic construct
  REGION 1..18: note = Synthetic peptide
  MOD_RES 2: note = Aib
  MOD_RES 6: note = C-alphaMe-Phe
  MOD_RES 10: note = Nal(2)
  MOD_RES 11: note = Aib
  MOD_RES 17: note = Aib
  MOD_RES 18: note = Lys(C12)
  REGION 1..18: note = C-term amide
HXQGTXTSDXXKYLERXX

SEQ ID NO: 108 - protein, 19 aa, synthetic construct
  REGION 1..19: note = Synthetic peptide
  MOD_RES 2: note = Aib
  MOD_RES 16: note = hArg
  MOD_RES 17: note = Aib
  MOD_RES 18: note = Lys(C8)
  MOD_RES 19: note = Aib
  REGION 1..19: note = C-term amide
HXQGTFTSDYSKYLDRXXX

SEQ ID NO: 109 - protein, 19 aa, synthetic construct
  REGION 1..19: note = Synthetic peptide
  MOD_RES 2: note = Aib
  MOD_RES 16: note = hArg
  MOD_RES 17: note = Aib
  MOD_RES 18: note = Lys(C12)
  MOD_RES 19: note = Aib
  REGION 1..19: note = C-term amide
HXQGTFTSDYSKYLDRXXX

SEQ ID NO: 110 - protein, 19 aa, synthetic construct
  REGION 1..19: note = Synthetic peptide
  MOD_RES 2: note = Aib
  MOD_RES 16: note = hArg
  MOD_RES 17: note = Aib
  MOD_RES 18: note = Lys(C16)
  MOD_RES 19: note = Aib
  REGION 1..19: note = C-term amide
HXQGTFTSDYSKYLDRXXX

SEQ ID NO: 111 - protein, 14 aa, synthetic construct
  REGION 1..14: note = Synthetic peptide
  MOD_RES 2: note = Aib
  MOD_RES 6: note = C-alphaMe-Phe
  MOD_RES 11: note = Aib
  MOD_RES 14: note = Lys(C12)
  REGION 1..14: note = C-term amide
HXQGTXTSDYXKYX

SEQ ID NO: 112 - protein, 14 aa, synthetic construct
  REGION 1..14: note = Synthetic peptide
  MOD_RES 2: note = Aib
  MOD_RES 6: note = C-alphaMe-Phe
  MOD_RES 11: note = Aib
  MOD_RES 14: note = Lys(C12)
  REGION 1..14: note = C-term NHEt
HXQGTXTSDYXKYX

SEQ ID NO: 113 - protein, 15 aa, synthetic construct
  REGION 1..15: note = Synthetic peptide
  MOD_RES 2: note = Aib
  MOD_RES 6: note = C-alphaMe-Phe
  MOD_RES 11: note = Aib
  MOD_RES 14: note = Lys(C12)
  MOD_RES 15: note = Aib
  REGION 1..15: note = C-term amide
HXQGTXTSDYXKYXX

SEQ ID NO: 114 - protein, 15 aa, synthetic construct
  REGION 1..15: note = Synthetic peptide
  MOD_RES 2: note = Aib
  MOD_RES 6: note = C-alphaMe-Phe
  MOD_RES 11: note = Aib
  MOD_RES 14: note = Lys(C12)
  MOD_RES 15: note = Aib
  REGION 1..15: note = C-term NHEt
HXQGTXTSDYXKYXX

SEQ ID NO: 115 - protein, 15 aa, synthetic construct
  REGION 1..15: note = Synthetic peptide
  MOD_RES 2: note = Aib
  MOD_RES 6: note = C-alphaMe-Phe
  MOD_RES 11: note = Aib
  MOD_RES 14: note = Lys(C12)
  MOD_RES 15: note = Ac5c
  REGION 1..15: note = C-term amide
HXQGTXTSDYXKYXX

SEQ ID NO: 116 - protein, 17 aa, synthetic construct
  REGION 1..17: note = Synthetic peptide
  MOD_RES 2: note = Aib
  MOD_RES 6: note = C-alphaMe-Phe
  MOD_RES 16: note = Aib
  MOD_RES 17: note = Lys(C8)
  REGION 1..17: note = C-term amide
HXQGTXTSDYSKYLDXX

SEQ ID NO: 117 - protein, 17 aa, synthetic construct
  REGION 1..17: note = Synthetic peptide
  MOD_RES 2: note = Aib
  MOD_RES 6: note = C-alphaMe-Phe
  MOD_RES 16: note = Aib
  MOD_RES 17: note = Lys(C16)
  REGION 1..17: note = C-term amide
HXQGTXTSDYSKYLDXX

SEQ ID NO: 118 - protein, 17 aa, synthetic construct
  REGION 1..17: note = Synthetic peptide
  MOD_RES 2: note = Aib
  MOD_RES 16: note = Aib
  MOD_RES 17: note = Lys(C8)
  REGION 1..17: note = C-term amide
HXQGTFTSDYSKYLDXX

SEQ ID NO: 119 - protein, 17 aa, synthetic construct
  REGION 1..17: note = Synthetic peptide
  MOD_RES 2: note = Aib
  MOD_RES 16: note = Aib
  MOD_RES 17: note = Lys(C12)
  REGION 1..17: note = C-term amide
HXQGTFTSDYSKYLDXX

SEQ ID NO: 120 - protein, 17 aa, synthetic construct
  REGION 1..17: note = Synthetic peptide
  MOD_RES 2: note = Aib
  MOD_RES 16: note = Aib
  MOD_RES 17: note = Lys(C16)
  REGION 1..17: note = C-term amide
HXQGTFTSDYSKYLDXX

SEQ ID NO: 121 - protein, 19 aa, synthetic construct
  REGION 1..19: note = Synthetic peptide
  MOD_RES 2: note = Aib
  MOD_RES 6: note = C-alphaMe-Phe
  MOD_RES 17: note = Aib
  MOD_RES 18: note = Lys(C8)
  MOD_RES 19: note = Aib
  REGION 1..19: note = C-term amide
HXQGTXTSDYSKYLDSXXX

SEQ ID NO: 122 - protein, 19 aa, synthetic construct
  REGION 1..19: note = Synthetic peptide
  MOD_RES 2: note = Aib
  MOD_RES 6: note = C-alphaMe-Phe
  MOD_RES 17: note = Aib
  MOD_RES 18: note = Lys(C12)
  MOD_RES 19: note = Aib
  REGION 1..19: note = C-term amide
HXQGTXTSDYSKYLDSXXX

SEQ ID NO: 123 - protein, 19 aa, synthetic construct
  REGION 1..19: note = Synthetic peptide
  MOD_RES 2: note = Aib
  MOD_RES 6: note = C-alphaMe-Phe
  MOD_RES 17: note = Aib
  MOD_RES 18: note = Lys(C16)
  MOD_RES 19: note = Aib
  REGION 1..19: note = C-term amide
HXQGTXTSDYSKYLDSXXX

SEQ ID NO: 124 - protein, 19 aa, synthetic construct
  REGION 1..19: note = Synthetic peptide
  MOD_RES 2: note = Aib
  MOD_RES 6: note = C-alphaMe-Phe
  MOD_RES 17: note = Aib
  MOD_RES 18: note = Lys(C8)
  MOD_RES 19: note = Ac5c
  REGION 1..19: note = C-term amide
HXQGTXTSDYSKYLDSXXX

SEQ ID NO: 125 - protein, 19 aa, synthetic construct
  REGION 1..19: note = Synthetic peptide
  MOD_RES 2: note = Aib
  MOD_RES 6: note = C-alphaMe-Phe
  MOD_RES 17: note = Aib
  MOD_RES 18: note = Lys(C12)
  MOD_RES 19: note = Ac5c
  REGION 1..19: note = C-term amide
HXQGTXTSDYSKYLDSXXX

SEQ ID NO: 126 - protein, 19 aa, synthetic construct
  REGION 1..19: note = Synthetic peptide
  MOD_RES 2: note = Aib
  MOD_RES 6: note = C-alphaMe-Phe
  MOD_RES 17: note = Aib
  MOD_RES 18: note = Lys(C16)
  MOD_RES 19: note = Ac5c
  REGION 1..19: note = C-term amide
HXQGTFTSDYSKYLDSXXX

SEQ ID NO: 127 - protein, 19 aa, synthetic construct
  REGION 1..19: note = Synthetic peptide
  MOD_RES 2: note = Aib
  MOD_RES 17: note = Aib
  MOD_RES 18: note = Lys(C8)
  MOD_RES 19: note = Ac5c
  REGION 1..19: note = C-term amide
HXQGTFTSDYSKYLDSXXX

SEQ ID NO: 128 - protein, 19 aa, synthetic construct
  REGION 1..19: note = Synthetic peptide
  MOD_RES 2: note = Aib
  MOD_RES 17: note = Aib
  MOD_RES 18: note = Lys(C12)
  MOD_RES 19: note = Ac5c
  REGION 1..19: note = C-term amide
HXQGTFTSDYSKYLDSXXX

SEQ ID NO: 129 - protein, 19 aa, synthetic construct
  REGION 1..19: note = Synthetic peptide
  MOD_RES 2: note = Aib
  MOD_RES 17: note = Aib
  MOD_RES 18: note = Lys(C16)
  MOD_RES 19: note = Ac5c
  REGION 1..19: note = C-term amide
HXQGTFTSDYSKYLDSXXX

SEQ ID NO: 130 - protein, 20 aa, synthetic construct
  REGION 1..20: note = Synthetic peptide
  MOD_RES 2: note = Aib
  MOD_RES 6: note = C-alphaMe-Phe
  MOD_RES 18: note = Aib
  MOD_RES 19: note = Lys(C8)
  MOD_RES 20: note = Aib
  REGION 1..20: note = C-term amide
HXQGTXTSDYSKYLDSRXXX

SEQ ID NO: 131 - protein, 20 aa, synthetic construct
  REGION 1..20: note = Synthetic peptide
  MOD_RES 2: note = Aib
  MOD_RES 6: note = C-alphaMe-Phe
  MOD_RES 18: note = Aib
  MOD_RES 19: note = Lys(C12)
  MOD_RES 20: note = Aib
  REGION 1..20: note = C-term amide
HXQGTXTSDYSKYLDSRXXX

SEQ ID NO: 132 - protein, 20 aa, synthetic construct
  REGION 1..20: note = Synthetic peptide
  MOD_RES 2: note = Aib
  MOD_RES 6: note = C-alphaMe-Phe
  MOD_RES 18: note = Aib
  MOD_RES 19: note = Lys(C16)
  MOD_RES 20: note = Aib
  REGION 1..20: note = C-term amide
HXQGTXTSDYSKYLDSRXXX

SEQ ID NO: 133 - protein, 20 aa, synthetic construct
  REGION 1..20: note = Synthetic peptide
  MOD_RES 2: note = Aib
  MOD_RES 6: note = C-alphaMe-Phe
  MOD_RES 18: note = Aib
  MOD_RES 19: note = Lys(C8)
  MOD_RES 20: note = Ac5c
  REGION 1..20: note = C-term amide
HXQGTXTSDYSKYLDSRXXX

SEQ ID NO: 134 - protein, 20 aa, synthetic construct
  REGION 1..20: note = Synthetic peptide
  MOD_RES 2: note = Aib
  MOD_RES 6: note = C-alphaMe-Phe
  MOD_RES 18: note = Aib
  MOD_RES 19: note = Lys(C12)
  MOD_RES 20: note = Ac5c
  REGION 1..20: note = C-term amide
HXQGTXTSDYSKYLDSRXXX

SEQ ID NO: 135 - protein, 20 aa, synthetic construct
  REGION 1..20: note = Synthetic peptide
  MOD_RES 2: note = Aib
  MOD_RES 6: note = C-alphaMe-Phe
  MOD_RES 18: note = Aib
  MOD_RES 19: note = Lys(C16)
  MOD_RES 20: note = Ac5c
  REGION 1..20: note = C-term amide
HXQGTXTSDYSKYLDSRXXX

SEQ ID NO: 136 - protein, 20 aa, synthetic construct
  REGION 1..20: note = Synthetic peptide
  MOD_RES 2: note = Aib
  MOD_RES 18: note = Aib
  MOD_RES 19: note = Lys(C8)
  MOD_RES 20: note = Aib
  REGION 1..20: note = C-term amide
HXQGTFTSDYSKYLDSRXXX

SEQ ID NO: 137 - protein, 20 aa, synthetic construct
  REGION 1..20: note = Synthetic peptide
  MOD_RES 2: note = Aib
  MOD_RES 18: note = Aib
  MOD_RES 19: note = Lys(C12)
  MOD_RES 20: note = Aib
  REGION 1..20: note = C-term amide
HXQGTFTSDYSKYLDSRXXX

SEQ ID NO: 138 - protein, 20 aa, synthetic construct
  REGION 1..20: note = Synthetic peptide
  MOD_RES 2: note = Aib
  MOD_RES 18: note = Aib
  MOD_RES 19: note = Lys(C16)
  MOD_RES 20: note = Aib
  REGION 1..20: note = C-term amide
HXQGTFTSDYSKYLDSRXXX

SEQ ID NO: 139 - protein, 23 aa, synthetic construct
  REGION 1..23: note = Synthetic peptide
  MOD_RES 2: note = Aib
  MOD_RES 6: note = C-alphaMe-Phe
  MOD_RES 18: note = Aib
  MOD_RES 21: note = Lys(C8)
  MOD_RES 23: note = Aib
  REGION 1..23: note = C-term amide
HXQGTXTSDYSKYLDSRXAQXFX

SEQ ID NO: 140 - protein, 23 aa, synthetic construct
  REGION 1..23: note = Synthetic peptide
  MOD_RES 2: note = Aib
  MOD_RES 6: note = C-alphaMe-Phe
  MOD_RES 18: note = Aib
  MOD_RES 21: note = Lys(C12)
  MOD_RES 23: note = Aib
  REGION 1..23: note = C-term amide
HXQGTXTSDYSKYLDSRXAQXFX

SEQ ID NO: 141 - protein, 23 aa, synthetic construct
  REGION 1..23: note = Synthetic peptide
  MOD_RES 2: note = Aib
  MOD_RES 6: note = C-alphaMe-Phe
  MOD_RES 18: note = Aib
  MOD_RES 21: note = Lys(C16)
  MOD_RES 23: note = Aib
  REGION 1..23: note = C-term amide
HXQGTXTSDYSKYLDSRXAQXFX

SEQ ID NO: 142 - protein, 23 aa, synthetic construct
  REGION 1..23: note = Synthetic peptide
  MOD_RES 2: note = Aib
  MOD_RES 6: note = C-alphaMe-Phe
  MOD_RES 18: note = Aib
  MOD_RES 21: note = Lys(C8)
  MOD_RES 23: note = Aib
  REGION 1..23: note = C-term amide
HXQGTXTSDYSKYLDSRXAQXFX

SEQ ID NO: 143 - protein, 23 aa, synthetic construct
  REGION 1..23: note = Synthetic peptide
  MOD_RES 2: note = Aib
  MOD_RES 6: note = C-alphaMe-Phe
  MOD_RES 18: note = Aib
  MOD_RES 21: note = Lys(C12)
  MOD_RES 23: note = Aib
  REGION 1..23: note = C-term amide
HXQGTXTSDYSKYLDSRXAQXFX

SEQ ID NO: 144 - protein, 23 aa, synthetic construct
  REGION 1..23: note = Synthetic peptide
  MOD_RES 2: note = Aib
  MOD_RES 6: note = C-alphaMe-Phe
  MOD_RES 18: note = Aib
  MOD_RES 21: note = Lys(C16)
  MOD_RES 23: note = Aib
  REGION 1..23: note = C-term amide
HXQGTXTSDYSKYLDSRXAQXFX

SEQ ID NO: 145 - protein, 23 aa, synthetic construct
  REGION 1..23: note = Synthetic peptide
  MOD_RES 2: note = Aib
  MOD_RES 6: note = C-alphaMe-Phe
  MOD_RES 18: note = Aib
  MOD_RES 21: note = Lys(C8)
  MOD_RES 23: note = Ac5c
  REGION 1..23: note = C-term amide
HXQGTXTSDYSKYLDSRXAQXFX

SEQ ID NO: 146 - protein, 23 aa, synthetic construct
  REGION 1..23: note = Synthetic peptide
  MOD_RES 2: note = Aib
  MOD_RES 6: note = C-alphaMe-Phe
  MOD_RES 18: note = Aib
  MOD_RES 21: note = Lys(C12)
  MOD_RES 23: note = Ac5c
  REGION 1..23: note = C-term amide
HXQGTXTSDYSKYLDSRXAQXFX

SEQ ID NO: 147 - protein, 23 aa, synthetic construct
  REGION 1..23: note = Synthetic peptide
  MOD_RES 2: note = Aib
  MOD_RES 6: note = C-alphaMe-Phe
  MOD_RES 18: note = Aib
  MOD_RES 21: note = Lys(C16)
  MOD_RES 23: note = Ac5c
  REGION 1..23: note = C-term amide
HXQGTXTSDYSKYLDSRXAQXFX

SEQ ID NO: 148 - protein, 23 aa, synthetic construct
  REGION 1..23: note = Synthetic peptide
  MOD_RES 2: note = Aib
  MOD_RES 6: note = C-alphaMe-Phe
  REGION 12..16: note = misc_feature - Cyclic
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C8)
  MOD_RES 23: note = Aib
  REGION 1..23: note = C-term amide
HXQGTXTSDYSXYLDXRXAQXFX

SEQ ID NO: 149 - protein, 23 aa, synthetic construct
  REGION 1..23: note = Synthetic peptide
  MOD_RES 2: note = Aib
  MOD_RES 6: note = C-alphaMe-Phe
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C12)
  MOD_RES 23: note = Aib
  REGION 1..23: note = C-term amide
HXQGTXTSDYSXYLDXRXAQXFX

SEQ ID NO: 150 - protein, 23 aa, synthetic construct
  REGION 1..23: note = Synthetic peptide
  MOD_RES 2: note = Aib
  MOD_RES 6: note = C-alphaMe-Phe
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C16)
  MOD_RES 23: note = Aib
  REGION 1..23: note = C-term amide
HXQGTXTSDYSXYLDXRXAQXFX

SEQ ID NO: 151 - protein, 23 aa, synthetic construct
  REGION 1..23: note = Synthetic peptide
  MOD_RES 2: note = Aib
  MOD_RES 6: note = C-alphaMe-Phe
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C8)
  MOD_RES 23: note = Ac5c
  REGION 1..23: note = C-term amide
HXQGTXTSDYSXYLDXRXAQXFX

SEQ ID NO: 152 - protein, 23 aa, synthetic construct
  REGION 1..23: note = Synthetic peptide
  MOD_RES 2: note = Aib
  MOD_RES 6: note = C-alphaMe-Phe
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C12)
  MOD_RES 23: note = Ac5c
  REGION 1..23: note = C-term amide
HXQGTXTSDYSXYLDXRXAQXFX

SEQ ID NO: 153 - protein, 23 aa, synthetic construct
  REGION 1..23: note = Synthetic peptide
  MOD_RES 2: note = Aib
  MOD_RES 6: note = C-alphaMe-Phe
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C16)
  MOD_RES 23: note = Ac5c
  REGION 1..23: note = C-term amide
HXQGTXTSDYSXYLDXRXAQXFX

SEQ ID NO: 154 - protein, 23 aa, synthetic construct
  REGION 1..23: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C8)
  MOD_RES 23: note = Ac5c
  REGION 1..23: note = C-term amide
HXQGTFTSDYSXYLDXRXAQXFX

SEQ ID NO: 155 - protein, 23 aa, synthetic construct
  REGION 1..23: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C12)
  MOD_RES 23: note = Ac5c
  REGION 1..23: note = C-term amide
HXQGTFTSDYSXYLDXRXAQXFX

SEQ ID NO: 156 - protein, 23 aa, synthetic construct
  REGION 1..23: note = Synthetic peptide
  MOD_RES 2: note = Aib
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C16)
  MOD_RES 23: note = Ac5c
  REGION 1..23: note = C-term amide
HXQGTFTSDYSXYLDXRXAQXFX

SEQ ID NO: 157 - protein, 23 aa, synthetic construct
  REGION 1..23: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C8)
  MOD_RES 23: note = Aib
  REGION 1..23: note = C-term amide
HXQGTFTSDYSXYLDXRXAQXFX

SEQ ID NO: 158 - protein, 23 aa, synthetic construct
  REGION 1..23: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C12)
  MOD_RES 23: note = Aib
  REGION 1..23: note = C-term amide
HXQGTFTSDYSXYLDXRXAQXFX

SEQ ID NO: 159 - protein, 23 aa, synthetic construct
  REGION 1..23: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Aib
  MOD_RES 21: note = Lys(C16)
  MOD_RES 23: note = Aib
  REGION 1..23: note = C-term amide
HXQGTFTSDYSXYLDXRXAQXFX

SEQ ID NO: 160 - protein, 23 aa, synthetic construct
  REGION 1..23: note = Synthetic peptide
  MOD_RES 2: note = Aib
  MOD_RES 6: note = C-alphaMe-Phe
  REGION 16..20: note = misc_feature - Cyclic
  MOD_RES 16: note = Glu is cyclized through side chain to form a lactam linkage
  MOD_RES 18: note = Aib
  MOD_RES 20: note = Lys is cyclized through side chain to form a lactam linkage
  MOD_RES 21: note = Lys(C8)
  MOD_RES 23: note = Aib
  REGION 1..23: note = C-term amide
HXQGTXTSDYSKYLDXRXAXXFX

SEQ ID NO: 161 - protein, 23 aa, synthetic construct
  REGION 1..23: note = Synthetic peptide
  MOD_RES 2: note = Aib
  MOD_RES 6: note = C-alphaMe-Phe
  REGION 16..20: note = misc_feature - Cyclic
  MOD_RES 16: note = Glu is cyclized through side chain to form a lactam linkage
  MOD_RES 18: note = Aib
  MOD_RES 20: note = Lys is cyclized through side chain to form a lactam linkage
  MOD_RES 21: note = Lys(C12)
  MOD_RES 23: note = Aib
  REGION 1..23: note = C-term amide
HXQGTXTSDYSKYLDXRXAXXFX

SEQ ID NO: 162 - protein, 23 aa, synthetic construct
  REGION 1..23: note = Synthetic peptide
  MOD_RES 2: note = Aib
  MOD_RES 6: note = C-alphaMe-Phe
  MOD_RES 16: note = Glu is cyclized through side chain to form a lactam linkage
  MOD_RES 18: note = Aib
  MOD_RES 20: note = Lys is cyclized through side chain to form a lactam linkage
  MOD_RES 21: note = Lys(C16)
  MOD_RES 23: note = Aib
  REGION 1..23: note = C-term amide
HXQGTXTSDYSKYLDXRXAXXFX

SEQ ID NO: 163 - protein, 23 aa, synthetic construct
  REGION 1..23: note = Synthetic peptide
  MOD_RES 2: note = Aib
  MOD_RES 6: note = C-alphaMe-Phe
  REGION 16..20: note = misc_feature - Cyclic
  MOD_RES 16: note = Glu is cyclized through side chain to form a lactam linkage
  MOD_RES 18: note = Aib
  MOD_RES 20: note = Lys is cyclized through side chain to form a lactam linkage
  MOD_RES 21: note = Lys(C8)
  MOD_RES 23: note = Ac5c
  REGION 1..23: note = C-term amide
HXQGTXTSDYSKYLDXRXAXXFX

SEQ ID NO: 164 - protein, 23 aa, synthetic construct
  REGION 1..23: note = Synthetic peptide
  MOD_RES 2: note = Aib
  MOD_RES 6: note = C-alphaMe-Phe
  REGION 16..20: note = misc_feature - Cyclic
  MOD_RES 16: note = Lys is cyclized through side chain to form a lactam linkage
  MOD_RES 18: note = Aib
  MOD_RES 20: note = Lys is cyclized through side chain to form a lactam linkage
  MOD_RES 21: note = Lys(C12)
  MOD_RES 23: note = Ac5c
  REGION 1..23: note = C-term amide
HXQGTXTSDYSKYLDXRXAXXFX

SEQ ID NO: 165 - protein, 23 aa, synthetic construct
  REGION 1..23: note = Synthetic peptide
  MOD_RES 2: note = Aib
  MOD_RES 6: note = C-alphaMe-Phe
  REGION 16..20: note = misc_feature - Cyclic
  MOD_RES 16: note = Lys is cyclized through side chain to form a lactam linkage
  MOD_RES 18: note = Aib
  MOD_RES 20: note = Lys is cyclized through side chain to form a lactam linkage
  MOD_RES 21: note = Lys(C16)
  MOD_RES 23: note = Ac5c
  REGION 1..23: note = C-term amide
HXQGTXTSDYSKYLDXRXAXXFX

SEQ ID NO: 166 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 18: note = Aib
  MOD_RES 20: note = Lys is cyclized through side chain to form a lactam linkage
  MOD_RES 21: note = Lys(C8)
  MOD_RES 23: note = Aib
  REGION 1..23: note = C-term amide
HXQGTFTSDYSKYLDXRXAXXFX

SEQ ID NO: 167 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 18: note = Aib
  MOD_RES 20: note = Lys is cyclized through side chain to form a lactam linkage
  MOD_RES 21: note = Lys(C12)
  MOD_RES 23: note = Aib
  REGION 1..23: note = C-term amide
HXQGTFTSDYSKYLDXRXAXXFX

SEQ ID NO: 168 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 18: note = Aib
  MOD_RES 20: note = Lys is cyclized through side chain to form a lactam linkage
  MOD_RES 21: note = Lys(C16)
  MOD_RES 23: note = Aib
  REGION 1..23: note = C-term amide
HXQGTFTSDYSKYLDXRXAXXFX

SEQ ID NO: 169 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 18: note = Aib
  MOD_RES 20: note = Lys is cyclized through side chain to form a lactam linkage
  MOD_RES 21: note = Lys(C8)
  MOD_RES 23: note = Ac5c
  REGION 1..23: note = C-term amide
HXQGTFTSDYSKYLDXRXAXXFX

SEQ ID NO: 170 - protein, 23 aa, synthetic construct
  REGION 1..23: note = Synthetic peptide
  MOD_RES 2: note = Aib
  MOD_RES 16: note = Lys is cyclized through side chain to form a lactam linkage
  MOD_RES 18: note = Aib
  MOD_RES 20: note = Lys is cyclized through side chain to form a lactam linkage
  MOD_RES 21: note = Lys(C12)
  MOD_RES 23: note = Ac5c
  REGION 1..23: note = C-term amide
HXQGTFTSDYSKYLDXRXAXXFX

SEQ ID NO: 171 - protein, 23 aa, synthetic construct
  REGION 1..23: note = Synthetic peptide
  MOD_RES 2: note = Aib
  MOD_RES 16: note = Lys is cyclized through side chain to form a lactam linkage
  MOD_RES 18: note = Aib
  MOD_RES 20: note = Lys is cyclized through side chain to form a lactam linkage
  MOD_RES 21: note = Lys(C16)
  MOD_RES 23: note = Ac5c
  REGION 1..23: note = C-term amide
HXQGTFTSDYSKYLDXRXAXXFX

SEQ ID NO: 172 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 21: note = Lys(C12)
  MOD_RES 23: note = Aib
  REGION 1..23: note = C-term amide
HXQGTFTSDYSKYLDXQAAXXFX

SEQ ID NO: 173 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 21: note = Lys(C16)
  MOD_RES 23: note = Aib
  REGION 1..23: note = C-term amide
HXQGTFTSDYSKYLDXQAAXXFX

SEQ ID NO: 174 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 21: note = Lys(C12)
  MOD_RES 23: note = Aib
  REGION 1..23: note = C-term amide
HXQGTFTSDYSKYLDXRAAXXFX

SEQ ID NO: 175 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 21: note = Lys(C16)
  MOD_RES 23: note = Aib
  REGION 1..23: note = C-term amide
HXQGTFTSDYSKYLDXRAAXXFX

SEQ ID NO: 176 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 21: note = Lys(C12)
  MOD_RES 23: note = Ac5c
  REGION 1..23: note = C-term amide
HXQGTFTSDYSKYLDXRAAXXFX

SEQ ID NO: 177 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 21: note = Lys(C16)
  MOD_RES 23: note = Ac5c
  REGION 1..23: note = C-term amide
HXQGTFTSDYSKYLDXRAAXXFX

SEQ ID NO: 178 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 21: note = Lys(C12)
  MOD_RES 23: note = Ac5c
  REGION 1..23: note = C-term amide
HXQGTFTSDYSKYLDXQAAXXFX

SEQ ID NO: 179 - protein, 23 aa, synthetic construct
  REGION 1..23: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 21: note = Lys(C12)
  MOD_RES 23: note = Aib
  REGION 1..23: note = C-term amide
HXQGTFTSDYSRYLDXRAAXXFX

SEQ ID NO: 180 - protein, 19 aa, synthetic construct
  REGION 1..19: note = Synthetic peptide
  MOD_RES 2: note = Aib
  MOD_RES 17: note = Aib
  MOD_RES 18: note = Lys(C12)
  MOD_RES 19: note = Aib
  REGION 1..19: note = C-term amide
HXQGTFTSDYSKYLDSXXX

SEQ ID NO: 181 - protein, 19 aa, synthetic construct
  REGION 1..19: note = Synthetic peptide
  MOD_RES 2: note = Aib
  MOD_RES 18: note = Lys(C12)
  MOD_RES 19: note = Aib
  REGION 1..19: note = C-term amide
HXQGTFTSDYSKYLDSRXX

SEQ ID NO: 182 - protein, 19 aa, synthetic construct
  REGION 1..19: note = Synthetic peptide
  MOD_RES 2: note = Aib
  MOD_RES 18: note = Lys(C12)
  MOD_RES 19: note = Ac5c
  REGION 1..19: note = C-term amide
HXQGTFTSDYSKYLDSRXX

SEQ ID NO: 183 - protein, 19 aa, synthetic construct
  REGION 1..19: note = Synthetic peptide
  MOD_RES 2: note = Aib
  MOD_RES 18: note = Lys(C8)
  MOD_RES 19: note = Aib
  REGION 1..19: note = C-term amide
HXQGTFTSDYSKYLDSRXX

SEQ ID NO: 184 - protein, 19 aa, synthetic construct
  REGION 1..19: note = Synthetic peptide
  MOD_RES 2: note = Aib
  MOD_RES 18: note = Lys(C16)
  MOD_RES 19: note = Aib
  REGION 1..19: note = C-term amide
HXQGTFTSDYSKYLDSRXX

SEQ ID NO: 185 - protein, 19 aa, synthetic construct
  REGION 1..19: note = Synthetic peptide
  MOD_RES 2: note = Aib
  MOD_RES 17: note = Aib
  MOD_RES 18: note = Lys(C12)
  MOD_RES 19: note = Aib
  REGION 1..19: note = C-term amide
HXQGTFTSDYSKYLDSXXX

SEQ ID NO: 186 - protein, 19 aa, synthetic construct
  REGION 1..19: note = Synthetic peptide
  MOD_RES 2: note = Aib
  MOD_RES 17: note = Aib
  MOD_RES 18: note = Lys(C8)
  MOD_RES 19: note = Aib
  REGION 1..19: note = C-term amide
HXQGTFTSDYSKYLDSXXX

SEQ ID NO: 187 - protein, 19 aa, synthetic construct
  REGION 1..19: note = Synthetic peptide
  MOD_RES 2: note = Aib
  MOD_RES 17: note = Aib
  MOD_RES 18: note = Lys(C1)
  MOD_RES 19: note = Aib
  REGION 1..19: note = C-term amide
HXQGTFTSDYSKYLDSXXX

SEQ ID NO: 188 - protein, 19 aa, synthetic construct
  REGION 1..19: note = Synthetic peptide
  MOD_RES 2: note = Aib
  MOD_RES 17: note = Aib
  MOD_RES 18: note = Lys(C16)
  MOD_RES 19: note = Aib
  REGION 1..19: note = C-term amide
HXQGTFTSDYSKYLDSXXX

SEQ ID NO: 189 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 17: note = Aib
  MOD_RES 18: note = Lys(C16)
  MOD_RES 19: note = Aib
  REGION 1..19: note = C-term amide
HXQGTFTSDYSXYLDXXXX

SEQ ID NO: 190 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 17: note = Aib
  MOD_RES 18: note = Lys(C12)
  MOD_RES 19: note = Aib
  REGION 1..19: note = C-term amide
HXQGTFTSDYSXYLDXXXX

SEQ ID NO: 191 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 17: note = Aib
  MOD_RES 18: note = Lys(C8)
  MOD_RES 19: note = Aib
  REGION 1..19: note = C-term amide
HXQGTFTSDYSXYLDXXXX

SEQ ID NO: 192 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C16)
  MOD_RES 19: note = Aib
  REGION 1..19: note = C-term amide
HXQGTFTSDYSXYLDXRXX

SEQ ID NO: 193 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C12)
  MOD_RES 19: note = Aib
  REGION 1..19: note = C-term amide
HXQGTFTSDYSXYLDXRXX

SEQ ID NO: 194 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C8)
  MOD_RES 19: note = Aib
  REGION 1..19: note = C-term amide
HXQGTFTSDYSXYLDXRXX

SEQ ID NO: 195 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C12)
  MOD_RES 19: note = Ac5c
  REGION 1..19: note = C-term amide
HXQGTFTSDYSXYLDXRXX

SEQ ID NO: 196 - protein, 18 aa, synthetic construct
  REGION 1..18: note = Synthetic peptide
  MOD_RES 2: note = Aib
  MOD_RES 17: note = Aib
  MOD_RES 18: note = Lys(C8)
  REGION 1..18: note = C-term amide
HXQGTFTSDYSKYLDRXX

SEQ ID NO: 197 - protein, 18 aa, synthetic construct
  REGION 1..18: note = Synthetic peptide
  MOD_RES 2: note = Aib
  MOD_RES 17: note = Aib
  MOD_RES 18: note = Lys(C12)
  REGION 1..18: note = C-term amide
HXQGTFTSDYSKYLDRXX

SEQ ID NO: 198 - protein, 18 aa, synthetic construct
  REGION 1..18: note = Synthetic peptide
  MOD_RES 2: note = Aib
  MOD_RES 17: note = Aib
  MOD_RES 18: note = Lys(C16)
  REGION 1..18: note = C-term amide
HXQGTFTSDYSKYLDRXX

SEQ ID NO: 199 - protein, 19 aa, synthetic construct
  REGION 1..19: note = Synthetic peptide
  MOD_RES 2: note = Aib
  MOD_RES 18: note = Aib
  MOD_RES 19: note = Lys(C8)
  REGION 1..19: note = C-term amide
HXQGTFTSDYSKYLDSRXX

SEQ ID NO: 200 - protein, 19 aa, synthetic construct
  REGION 1..19: note = Synthetic peptide
  MOD_RES 2: note = Aib
  MOD_RES 18: note = Aib
  MOD_RES 19: note = Lys(C12)
  REGION 1..19: note = C-term amide
HXQGTFTSDYSKYLDSRXX

SEQ ID NO: 201 - protein, 19 aa, synthetic construct
  REGION 1..19: note = Synthetic peptide
  MOD_RES 2: note = Aib
  MOD_RES 18: note = Aib
  MOD_RES 19: note = Lys(C16)
  REGION 1..19: note = C-term amide
HXQGTFTSDYSKYLDSRXX

SEQ ID NO: 202 - protein, 19 aa, synthetic construct
  REGION 1..19: note = Synthetic peptide
  MOD_RES 2: note = Aib
  MOD_RES 16: note = Aib
  MOD_RES 18: note = Aib
  MOD_RES 19: note = Lys(C8)
  REGION 1..19: note = C-term amide
HXQGTFTSDYSKYLDXRXX

SEQ ID NO: 203 - protein, 19 aa, synthetic construct
  REGION 1..19: note = Synthetic peptide
  MOD_RES 2: note = Aib
  MOD_RES 16: note = Aib
  MOD_RES 18: note = Aib
  MOD_RES 19: note = Lys(C12)
  REGION 1..19: note = C-term amide
HXQGTFTSDYSKYLDXRXX

SEQ ID NO: 204 - protein, 19 aa, synthetic construct
  REGION 1..19: note = Synthetic peptide
  MOD_RES 2: note = Aib
  MOD_RES 16: note = Aib
  MOD_RES 18: note = Aib
  MOD_RES 19: note = Lys(C16)
  REGION 1..19: note = C-term amide
HXQGTFTSDYSKYLDXRXX

SEQ ID NO: 205 - protein, 18 aa, synthetic construct
  REGION 1..18: note = Synthetic peptide
  MOD_RES 2: note = Aib
  MOD_RES 17: note = Aib
  MOD_RES 18: note = Lys(C8)
  REGION 1..18: note = C-term amide
HXQGTFTSDVSSYLERXX

SEQ ID NO: 206 - protein, 18 aa, synthetic construct
  REGION 1..18: note = Synthetic peptide
  MOD_RES 2: note = Aib
  MOD_RES 17: note = Aib
  MOD_RES 18: note = Lys(C12)
  REGION 1..18: note = C-term amide
HXQGTFTSDVSSYLERXX

SEQ ID NO: 207 - protein, 18 aa, synthetic construct
  REGION 1..18: note = Synthetic peptide
  MOD_RES 2: note = Aib
  MOD_RES 17: note = Aib
  MOD_RES 18: note = Lys(C16)
  REGION 1..18: note = C-term amide
HXQGTFTSDVSSYLERXX

SEQ ID NO: 208 - protein, 19 aa, synthetic construct
  REGION 1..19: note = Synthetic peptide
  MOD_RES 2: note = Aib
  MOD_RES 16: note = Aib
  MOD_RES 18..19: note = Lys(C8)
  REGION 1..19: note = C-term amide
HXQGTFTSDVSSYLEXRXX

SEQ ID NO: 209 - protein, 19 aa, synthetic construct
  REGION 1..19: note = Synthetic peptide
  MOD_RES 2: note = Aib
  MOD_RES 16: note = Aib
  MOD_RES 18..19: note = Lys(C12)
  REGION 1..19: note = C-term amide
HXQGTFTSDVSSYLEXRXX

SEQ ID NO: 210 - protein, 19 aa, synthetic construct
  REGION 1..19: note = Synthetic peptide
  MOD_RES 2: note = Aib
  MOD_RES 16: note = Aib
  MOD_RES 18..19: note = Lys(C16)
  REGION 1..19: note = C-term amide
HXQGTFTSDVSSYLEXRXX

SEQ ID NO: 211 - protein, 18 aa, synthetic construct
  REGION 1..18: note = Synthetic peptide
  MOD_RES 2: note = Aib
  MOD_RES 16: note = hArg
  MOD_RES 17: note = Aib
  MOD_RES 18: note = Lys(C8)
  REGION 1..18: note = C-term amide
HXQGTFTSDYSKYLDXXX

SEQ ID NO: 212 - protein, 18 aa, synthetic construct
  REGION 1..18: note = Synthetic peptide
  MOD_RES 2: note = Aib
  MOD_RES 16: note = hArg
  MOD_RES 17: note = Aib
  MOD_RES 18: note = Lys(C12)
  REGION 1..18: note = C-term amide
HXQGTFTSDYSKYLDXXX

SEQ ID NO: 213 - protein, 18 aa, synthetic construct
  REGION 1..18: note = Synthetic peptide
  MOD_RES 2: note = Aib
  MOD_RES 16: note = hArg
  MOD_RES 17: note = Aib
  MOD_RES 18: note = Lys(C16)
  REGION 1..18: note = C-term amide
HXQGTFTSDYSKYLDXXX

SEQ ID NO: 214 - protein, 19 aa, synthetic construct
  REGION 1..19: note = Synthetic peptide
  MOD_RES 2: note = Aib
  MOD_RES 16: note = Aib
  MOD_RES 17: note = hArg
  MOD_RES 18: note = Aib
  MOD_RES 19: note = Lys(C8)
  REGION 1..19: note = C-term amide
HXQGTFTSDYSKYLDXXXX

SEQ ID NO: 215 - protein, 19 aa, synthetic construct
  REGION 1..19: note = Synthetic peptide
  MOD_RES 2: note = Aib
  MOD_RES 16: note = Aib
  MOD_RES 17: note = hArg
  MOD_RES 18: note = Aib
  MOD_RES 19: note = Lys(C12)
  REGION 1..19: note = C-term amide
HXQGTFTSDYSKYLDXXXX

SEQ ID NO: 216 - protein, 19 aa, synthetic construct
  REGION 1..19: note = Synthetic peptide
  MOD_RES 2: note = Aib
  MOD_RES 16: note = Aib
  MOD_RES 17: note = hArg
  MOD_RES 18: note = Aib
  MOD_RES 19: note = Lys(C16)
  REGION 1..19: note = C-term amide
HXQGTFTSDYSKYLDXXXX

SEQ ID NO: 217 - protein, 18 aa, synthetic construct
  REGION 1..18: note = Synthetic peptide
  MOD_RES 2: note = Aib
  MOD_RES 16: note = hArg
  MOD_RES 17: note = Aib
  MOD_RES 18: note = Lys(C8)
  REGION 1..18: note = C-term amide
HXQGTFTSDVSSYLEXXX

SEQ ID NO: 218 - protein, 18 aa, synthetic construct
  REGION 1..18: note = Synthetic peptide
  MOD_RES 2: note = Aib
  MOD_RES 16: note = hArg
  MOD_RES 17: note = Aib
  MOD_RES 18: note = Lys(C12)
  REGION 1..18: note = C-term amide
HXQGTFTSDVSSYLEXXX

SEQ ID NO: 219 - protein, 22 aa, synthetic construct
  REGION 1..22: note = Synthetic peptide
  MOD_RES 21: note = Lys(C12)
  MOD_RES 22: note = Aib
  REGION 1..22: note = C-term amide
HSQGTFTSDYSKYLDSRRAQXX

SEQ ID NO: 220 - protein, 21 aa, synthetic construct
  REGION 1..21: note = Synthetic peptide
  MOD_RES 20: note = Lys(C12)
  MOD_RES 21: note = Aib
  REGION 1..21: note = C-term amide
HSQGTFTSDYSKYLDSRRAXX

SEQ ID NO: 221 - protein, 20 aa, synthetic construct
  REGION 1..20: note = Synthetic peptide
  MOD_RES 19: note = Lys(C12)
  MOD_RES 20: note = Aib
  REGION 1..20: note = C-term amide
HSQGTFTSDYSKYLDSRRXX

SEQ ID NO: 222 - protein, 19 aa, synthetic construct
  REGION 1..19: note = Synthetic peptide
  MOD_RES 18: note = Lys(C12)
  MOD_RES 19: note = Aib
  REGION 1..19: note = C-term amide
HSQGTFTSDYSKYLDSRXX

SEQ ID NO: 223 - protein, 18 aa, synthetic construct
  REGION 1..18: note = Synthetic peptide
  MOD_RES 17: note = Lys(C12)
  MOD_RES 18: note = Aib
  REGION 1..18: note = C-term amide
HSQGTFTSDYSKYLDSXX

SEQ ID NO: 224 - protein, 17 aa, synthetic construct
  REGION 1..17: note = Synthetic peptide
  MOD_RES 16: note = Lys(C12)
  MOD_RES 17: note = Aib
  REGION 1..17: note = C-term amide
HSQGTFTSDYSKYLDXX

SEQ ID NO: 225 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C12)
  REGION 1..29: note = C-term amide
HXQGTFTSDYSKYLDXQAAXEFIXWLMNT

SEQ ID NO: 226 - protein, 21 aa, synthetic construct
  REGION 1..21: note = Synthetic peptide
  MOD_RES 21: note = Lys(C12)
  REGION 1..21: note = C-term amide
HSQGTFTSDYSKYLDSRRAQX

SEQ ID NO: 227 - protein, 20 aa, synthetic construct
  REGION 1..20: note = Synthetic peptide
  MOD_RES 20: note = Lys(C12)
  REGION 1..20: note = C-term amide
HSQGTFTSDYSKYLDSRRAX

SEQ ID NO: 228 - protein, 19 aa, synthetic construct
  REGION 1..19: note = Synthetic peptide
  MOD_RES 19: note = Lys(C12)
  REGION 1..19: note = C-term amide
HSQGTFTSDYSKYLDSRRX

SEQ ID NO: 229 - protein, 18 aa, synthetic construct
  REGION 1..18: note = Synthetic peptide
  MOD_RES 18: note = Lys(C12)
  REGION 1..18: note = C-term amide
HSQGTFTSDYSKYLDSRX

SEQ ID NO: 230 - protein, 17 aa, synthetic construct
  REGION 1..17: note = Synthetic peptide
  MOD_RES 17: note = Lys(C12)
  REGION 1..17: note = C-term amide
HSQGTFTSDYSKYLDSX

SEQ ID NO: 231 - protein, 16 aa, synthetic construct
  REGION 1..16: note = Synthetic peptide
  MOD_RES 16: note = Lys(C12)
  REGION 1..16: note = C-term amide
HSQGTFTSDYSKYLDX

SEQ ID NO: 232 - protein, 21 aa, synthetic construct
  REGION 1..21: note = Synthetic peptide
  MOD_RES 20: note = Lys(C12)
  MOD_RES 21: note = Aib
  REGION 1..21: note = C-term amide
HAEGTFTSDVSSYLEGQAAXX

SEQ ID NO: 233 - protein, 20 aa, synthetic construct
  REGION 1..20: note = Synthetic peptide
  MOD_RES 19: note = Lys(C12)
  MOD_RES 20: note = Aib
  REGION 1..20: note = C-term amide
HAEGTFTSDVSSYLEGQAXX

SEQ ID NO: 234 - protein, 19 aa, synthetic construct
  REGION 1..19: note = Synthetic peptide
  MOD_RES 18: note = Lys(C12)
  MOD_RES 19: note = Aib
  REGION 1..19: note = C-term amide
HAEGTFTSDVSSYLEGQXX

SEQ ID NO: 235 - protein, 18 aa, synthetic construct
  REGION 1..18: note = Synthetic peptide
  MOD_RES 17: note = Lys(C12)
  MOD_RES 18: note = Aib
  REGION 1..18: note = C-term amide
HAEGTFTSDVSSYLEGXX

SEQ ID NO: 236 - protein, 17 aa, synthetic construct
  REGION 1..17: note = Synthetic peptide
  MOD_RES 16: note = Lys(C12)
  MOD_RES 17: note = Aib
  REGION 1..17: note = C-term amide
HAEGTFTSDVSSYLEXX

SEQ ID NO: 237 - protein, 16 aa, synthetic construct
  REGION 1..16: note = Synthetic peptide
  MOD_RES 15: note = Lys(C12)
  MOD_RES 16: note = Aib
  REGION 1..16: note = C-term amide
HAEGTFTSDVSSYLXX

SEQ ID NO: 238 - protein, 17 aa, synthetic construct
  REGION 1..17: note = Synthetic peptide
  MOD_RES 2: note = Aib
  MOD_RES 16: note = Lys(C12)
  MOD_RES 17: note = Aib
  REGION 1..17: note = C-term amide
HXQGTFTSDYSKYLDXX

SEQ ID NO: 239 - protein, 17 aa, synthetic construct
  REGION 1..17: note = Synthetic peptide
  MOD_RES 2: note = Aib
  MOD_RES 16: note = Lys(C12)
  MOD_RES 17: note = Ac4c
  REGION 1..17: note = C-term amide
HXQGTFTSDYSKYLDXX

SEQ ID NO: 240 - protein, 19 aa, synthetic construct
  REGION 1..19: note = Synthetic peptide
  MOD_RES 2: note = Aib
  MOD_RES 16: note = Lys(C12)
  MOD_RES 19: note = Aib
  REGION 1..19: note = C-term amide
HXQGTFTSDYSKYLDXRRX

SEQ ID NO: 241 - protein, 18 aa, synthetic construct
  REGION 1..18: note = Synthetic peptide
  MOD_RES 2: note = Aib
  MOD_RES 16: note = Lys(C12)
  MOD_RES 17: note = Aib
  REGION 1..18: note = C-term amide
HXQGTFTSDYSKYLDXXR

SEQ ID NO: 242 - protein, 18 aa, synthetic construct
  REGION 1..18: note = Synthetic peptide
  MOD_RES 2: note = Aib
  MOD_RES 16: note = Lys(C12)
  MOD_RES 18: note = Aib
  REGION 1..18: note = C-term amide
HXQGTFTSDYSKYLDXRX

SEQ ID NO: 243 - protein, 18 aa, synthetic construct
  REGION 1..18: note = Synthetic peptide
  MOD_RES 2: note = Aib
  MOD_RES 16: note = Lys(C12)
  MOD_RES 17: note = hArg
  MOD_RES 18: note = Aib
  REGION 1..18: note = C-term amide
HXQGTFTSDYSKYLDXXX

SEQ ID NO: 244 - protein, 18 aa, synthetic construct
  REGION 1..18: note = Synthetic peptide
  MOD_RES 2: note = Aib
  MOD_RES 17: note = Lys(C12)
  MOD_RES 18: note = Aib
  REGION 1..18: note = C-term amide
HXQGTFTSDYSKYLDSXX

SEQ ID NO: 245 - protein, 18 aa, synthetic construct
  REGION 1..18: note = Synthetic peptide
  MOD_RES 2: note = Aib
  MOD_RES 17: note = Lys(C12)
  MOD_RES 18: note = Ac4c
  REGION 1..18: note = C-term amide
HXQGTFTSDYSKYLDSXX

SEQ ID NO: 246 - protein, 19 aa, synthetic construct
  REGION 1..19: note = Synthetic peptide
  MOD_RES 2: note = Aib
  MOD_RES 17: note = Lys(C12)
  MOD_RES 19: note = Aib
  REGION 1..19: note = C-term amide
HXQGTFTSDYSKYLDSXRX

SEQ ID NO: 247 - protein, 19 aa, synthetic construct
  REGION 1..19: note = Synthetic peptide
  MOD_RES 2: note = Aib
  MOD_RES 17: note = Lys(C12)
  MOD_RES 18: note = hArg
  MOD_RES 19: note = Aib
  REGION 1..19: note = C-term amide
HXQGTFTSDYSKYLDSXXX

SEQ ID NO: 248 - protein, 19 aa, synthetic construct
  REGION 1..19: note = Synthetic peptide
  MOD_RES 2: note = Aib
  MOD_RES 18: note = Lys(C12)
  MOD_RES 19: note = Aib
  REGION 1..19: note = C-term amide
HXQGTFTSDYSKYLDSRXX

SEQ ID NO: 249 - protein, 19 aa, synthetic construct
  REGION 1..19: note = Synthetic peptide
  MOD_RES 2: note = Aib
  MOD_RES 18: note = Lys(C12)
  MOD_RES 19: note = Ac4c
  REGION 1..19: note = C-term amide
HXQGTFTSDYSKYLDSRXX

SEQ ID NO: 250 - protein, 19 aa, synthetic construct
  REGION 1..19: note = Synthetic peptide
  MOD_RES 2: note = Aib
  MOD_RES 17: note = hArg
  MOD_RES 18: note = Lys(C12)
  MOD_RES 19: note = Aib
  REGION 1..19: note = C-term amide
HXQGTFTSDYSKYLDSXXX

SEQ ID NO: 251 - protein, 19 aa, synthetic construct
  REGION 1..19: note = Synthetic peptide
  MOD_RES 2: note = Aib
  MOD_RES 16: note = Aib
  MOD_RES 18: note = Lys(C12)
  MOD_RES 19: note = Aib
  REGION 1..19: note = C-term amide
HXQGTFTSDYSKYLDXRXX

SEQ ID NO: 252 - protein, 19 aa, synthetic construct
  REGION 1..19: note = Synthetic peptide
  MOD_RES 2: note = Aib
  MOD_RES 18: note = Lys(C14)
  MOD_RES 19: note = Aib
  REGION 1..19: note = C-term amide
HXQGTFTSDYSKYLDSRXX

SEQ ID NO: 253 - protein, 19 aa, synthetic construct
  REGION 1..19: note = Synthetic peptide
  MOD_RES 2: note = Aib
  MOD_RES 18: note = Lys(C16)
  MOD_RES 19: note = Aib
  REGION 1..19: note = C-term amide
HXQGTFTSDYSKYLDSRXX

SEQ ID NO: 254 - protein, 19 aa, synthetic construct
  REGION 1..19: note = Synthetic peptide
  MOD_RES 2: note = Aib
  MOD_RES 18: note = Lys(C18)
  MOD_RES 19: note = Aib
  REGION 1..19: note = C-term amide
HXQGTFTSDYSKYLDSRXX

SEQ ID NO: 255 - protein, 19 aa, synthetic construct
  REGION 1..19: note = Synthetic peptide
  MOD_RES 2: note = Aib
  MOD_RES 16: note = Aib
  MOD_RES 18: note = Lys(C12)
  MOD_RES 19: note = Aib
  REGION 1..19: note = C-term amide
HXQGTFTSDYSKYLDXQXX

SEQ ID NO: 256 - protein, 20 aa, synthetic construct
  REGION 1..20: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 18: note = Lys(C12)
  MOD_RES 20: note = Lys is cyclized through side chain to form a lactam linkage
  REGION 1..20: note = C-term amide
HXQGTFTSDYSKYLDXQXAX

SEQ ID NO: 257 - protein, 20 aa, synthetic construct
  REGION 1..20: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 18: note = Lys(C14)
  MOD_RES 20: note = Lys is cyclized through side chain to form a lactam linkage
  REGION 1..20: note = C-term amide
HXQGTFTSDYSKYLDXQXAX

SEQ ID NO: 258 - protein, 20 aa, synthetic construct
  REGION 1..20: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 18: note = Lys(C16)
  MOD_RES 20: note = Lys is cyclized through side chain to form a lactam linkage
  REGION 1..20: note = C-term amide
HXQGTFTSDYSKYLDXQXAX

SEQ ID NO: 259 - protein, 20 aa, synthetic construct
  REGION 1..20: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 18: note = Lys(C18)
  MOD_RES 20: note = Lys is cyclized through side chain to form a lactam linkage
  REGION 1..20: note = C-term amide
HXQGTFTSDYSKYLDXQXAX

SEQ ID NO: 260 - protein, 20 aa, synthetic construct
  REGION 1..20: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 18: note = Lys(C20)
  MOD_RES 20: note = Lys is cyclized through side chain to form a lactam linkage
  REGION 1..20: note = C-term amide
HXQGTFTSDYSKYLDXQXAX

SEQ ID NO: 261 - protein, 20 aa, synthetic construct
  REGION 1..20: note = Synthetic peptide
  MOD_RES 2: note = Aib
  MOD_RES 18: note = Lys(C12)
  MOD_RES 19..20: note = Aib
  REGION 1..20: note = C-term amide
HXQGTFTSDYSKYLDSRXXX

SEQ ID NO: 262 - protein, 20 aa, synthetic construct
  REGION 1..20: note = Synthetic peptide
  MOD_RES 2: note = Aib
  MOD_RES 18: note = Lys(C14)
  MOD_RES 19..20: note = Aib
  REGION 1..20: note = C-term amide
HXQGTFTSDYSKYLDSRXXX

SEQ ID NO: 263 - protein, 20 aa, synthetic construct
  REGION 1..20: note = Synthetic peptide
  MOD_RES 2: note = Aib
  MOD_RES 18: note = Lys(C16)
  MOD_RES 19..20: note = Aib
  REGION 1..20: note = C-term amide
HXQGTFTSDYSKYLDSRXXX

SEQ ID NO: 264 - protein, 20 aa, synthetic construct
  REGION 1..20: note = Synthetic peptide
  MOD_RES 2: note = Aib
  MOD_RES 18: note = Lys(C18)
  MOD_RES 19..20: note = Aib
  REGION 1..20: note = C-term amide
HXQGTFTSDYSKYLDSRXXX

SEQ ID NO: 265 - protein, 20 aa, synthetic construct
  REGION 1..20: note = Synthetic peptide
  MOD_RES 2: note = Aib
  MOD_RES 18: note = Lys(C20)
  MOD_RES 19..20: note = Aib
  REGION 1..20: note = C-term amide
HXQGTFTSDYSKYLDSRXXX

SEQ ID NO: 266 - skipped

SEQ ID NO: 267 - protein, 18 aa, synthetic construct
  REGION 1..18: note = Synthetic peptide
  MOD_RES 2: note = Aib
  MOD_RES 16..17: note = Aib
  MOD_RES 18: note = Lys(C12)
  REGION 1..18: note = C-term amide
HXQGTFTSDYSKYLDXXX

SEQ ID NO: 268 - protein, 18 aa, synthetic construct
  REGION 1..18: note = Synthetic peptide
  MOD_RES 2: note = Aib
  MOD_RES 16..17: note = Aib
  MOD_RES 18: note = Lys(C14)
  REGION 1..18: note = C-term amide
HXQGTFTSDYSKYLDXXX

SEQ ID NO: 269 - protein, 18 aa, synthetic construct
  REGION 1..18: note = Synthetic peptide
  MOD_RES 2: note = Aib
  MOD_RES 16..17: note = Aib
  MOD_RES 18: note = Lys(C16)
  REGION 1..18: note = C-term amide
HXQGTFTSDYSKYLDXXX

SEQ ID NO: 270 - protein, 18 aa, synthetic construct
  REGION 1..18: note = Synthetic peptide
  MOD_RES 2: note = Aib
  MOD_RES 16..17: note = Aib
  MOD_RES 18: note = Lys(C18)
  REGION 1..18: note = C-term amide
HXQGTFTSDYSKYLDXXX

SEQ ID NO: 271 - protein, 18 aa, synthetic construct
  REGION 1..18: note = Synthetic peptide
  MOD_RES 2: note = Aib
  MOD_RES 16..17: note = Aib
  MOD_RES 18: note = Lys(C20)
  REGION 1..18: note = C-term amide
HXQGTFTSDYSKYLDXXX

SEQ ID NO: 272 - protein, 20 aa, synthetic construct
  REGION 1..20: note = Synthetic peptide
  MOD_RES 2: note = Aib
  MOD_RES 17: note = Aib
  MOD_RES 18: note = Lys(C12)
  MOD_RES 19..20: note = Aib
  REGION 1..20: note = C-term amide
HXQGTFTSDYSKYLDSXXXX

SEQ ID NO: 273 - protein, 20 aa, synthetic construct
  REGION 1..20: note = Synthetic peptide
  MOD_RES 2: note = Aib
  MOD_RES 17: note = Aib
  MOD_RES 18: note = Lys(C14)
  MOD_RES 19..20: note = Aib
  REGION 1..20: note = C-term amide
HXQGTFTSDYSKYLDSXXXX

SEQ ID NO: 274 - protein, 20 aa, synthetic construct
  REGION 1..20: note = Synthetic peptide
  MOD_RES 2: note = Aib
  MOD_RES 17: note = Aib
  MOD_RES 18: note = Lys(C16)
  MOD_RES 19..20: note = Aib
  REGION 1..20: note = C-term amide
HXQGTFTSDYSKYLDSXXXX

SEQ ID NO: 275 - protein, 20 aa, synthetic construct
  REGION 1..20: note = Synthetic peptide
  MOD_RES 2: note = Aib
  MOD_RES 17: note = Aib
  MOD_RES 18: note = Lys(C18)
  MOD_RES 19..20: note = Aib
  REGION 1..20: note = C-term amide
HXQGTFTSDYSKYLDSXXXX

SEQ ID NO: 276 - protein, 20 aa, synthetic construct
  REGION 1..20: note = Synthetic peptide
  MOD_RES 2: note = Aib
  MOD_RES 17: note = Aib
  MOD_RES 18: note = Lys(C20)
  MOD_RES 19..20: note = Aib
  REGION 1..20: note = C-term amide
HXQGTFTSDYSKYLDSXXXX

SEQ ID NO: 277 - protein, 20 aa, synthetic construct
  REGION 1..20: note = Synthetic peptide
  MOD_RES 2: note = Aib
  MOD_RES 17: note = Aib
  MOD_RES 18: note = Lys(C22)
  MOD_RES 19..20: note = Aib
  REGION 1..20: note = C-term amide
HXQGTFTSDYSKYLDSXXXX

SEQ ID NO: 278 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C12)
  MOD_RES 19: note = Aib
  REGION 1..19: note = C-term amide
HXQGTFTSDYSXYLDXRXX

SEQ ID NO: 279 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C14)
  MOD_RES 19: note = Aib
  REGION 1..19: note = C-term amide
HXQGTFTSDYSXYLDXRXX

SEQ ID NO: 280 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C16)
  MOD_RES 19: note = Aib
  REGION 1..19: note = C-term amide
HXQGTFTSDYSXYLDXRXX

SEQ ID NO: 281 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C18)
  MOD_RES 19: note = Aib
  REGION 1..19: note = C-term amide
HXQGTFTSDYSXYLDXRXX

SEQ ID NO: 282 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C20)
  MOD_RES 19: note = Aib
  REGION 1..19: note = C-term amide
HXQGTFTSDYSXYLDXRXX

SEQ ID NO: 283 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C12)
  MOD_RES 19: note = Aib
  REGION 1..19: note = C-term amide
HXQGTFTSDYSXYLDXQXX

SEQ ID NO: 284 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C14)
  MOD_RES 19: note = Aib
  REGION 1..19: note = C-term amide
HXQGTFTSDYSXYLDXQXX

SEQ ID NO: 285 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C16)
  MOD_RES 19: note = Aib
  REGION 1..19: note = C-term amide
HXQGTFTSDYSXYLDXQXX

SEQ ID NO: 286 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C18)
  MOD_RES 19: note = Aib
  REGION 1..19: note = C-term amide
HXQGTFTSDYSXYLDXQXX

SEQ ID NO: 287 - protein, 19 aa, synthetic construct
  REGION 1..19: note = Synthetic peptide
  MOD_RES 2: note = Aib
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C20)
  MOD_RES 19: note = Aib
  REGION 1..19: note = C-term amide
HXQGTFTSDYSXYLDXQXX

SEQ ID NO: 288 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C12)
  MOD_RES 19..20: note = Aib
  REGION 1..20: note = C-term amide
HXQGTFTSDYSXYLDXRXXX

SEQ ID NO: 289 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C14)
  MOD_RES 19..20: note = Aib
  REGION 1..20: note = C-term amide
HXQGTFTSDYSXYLDXRXXX

SEQ ID NO: 290 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C16)
  MOD_RES 19..20: note = Aib
  REGION 1..20: note = C-term amide
HXQGTFTSDYSXYLDXRXXX

SEQ ID NO: 291 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C18)
  MOD_RES 19..20: note = Aib
  REGION 1..20: note = C-term amide
HXQGTFTSDYSXYLDXRXXX

SEQ ID NO: 292 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C20)
  MOD_RES 19..20: note = Aib
  REGION 1..20: note = C-term amide
HXQGTFTSDYSXYLDXRXXX

SEQ ID NO: 293 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C12)
  MOD_RES 19..20: note = Aib
  REGION 1..20: note = C-term amide
HXQGTFTSDYSXYLDXXXXX

SEQ ID NO: 294 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C14)
  MOD_RES 19..20: note = Aib
  REGION 1..20: note = C-term amide
HXQGTFTSDYSXYLDXXXXX

SEQ ID NO: 295 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C16)
  MOD_RES 19..20: note = Aib
  REGION 1..20: note = C-term amide
HXQGTFTSDYSXYLDXXXXX

SEQ ID NO: 296 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C18)
  MOD_RES 19..20: note = Aib
  REGION 1..20: note = C-term amide
HXQGTFTSDYSXYLDXXXXX

SEQ ID NO: 297 - protein, 20 aa, synthetic construct
  REGION 1..20: note = Synthetic peptide
  MOD_RES 2: note = Aib
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C20)
  MOD_RES 19..20: note = Aib
  REGION 1..20: note = C-term amide
HXQGTFTSDYSXYLDXXXXX

SEQ ID NO: 298 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C12)
  MOD_RES 19..20: note = Aib
  REGION 1..20: note = C-term amide
HXQGTFTSDYSXYLDXRXXX

SEQ ID NO: 299 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C14)
  MOD_RES 19..20: note = Aib
  REGION 1..20: note = C-term amide
HXQGTFTSDYSXYLDXRXXX

SEQ ID NO: 300 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C16)
  MOD_RES 19..20: note = Aib
  REGION 1..20: note = C-term amide
HXQGTFTSDYSXYLDXRXXX

SEQ ID NO: 301 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C18)
  MOD_RES 19..20: note = Aib
  REGION 1..20: note = C-term amide
HXQGTFTSDYSXYLDXRXXX

SEQ ID NO: 302 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 18: note = Lys(C20)
  MOD_RES 19..20: note = Aib
  REGION 1..20: note = C-term amide
HXQGTFTSDYSXYLDXRXXX

SEQ ID NO: 303 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 17: note = hArg
  MOD_RES 18: note = Lys(C12)
  MOD_RES 19..20: note = Aib
  REGION 1..20: note = C-term amide
HXQGTFTSDYSXYLDXXXXX

SEQ ID NO: 304 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 17: note = hArg
  MOD_RES 18: note = Lys(C14)
  MOD_RES 19..20: note = Aib
  REGION 1..20: note = C-term amide
HXQGTFTSDYSXYLDXXXXX

SEQ ID NO: 305 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 17: note = hArg
  MOD_RES 18: note = Lys(C16)
  MOD_RES 19..20: note = Aib
  REGION 1..20: note = C-term amide
HXQGTFTSDYSXYLDXXXXX

SEQ ID NO: 306 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 17: note = hArg
  MOD_RES 18: note = Lys(C18)
  MOD_RES 19..20: note = Aib
  REGION 1..20: note = C-term amide
HXQGTFTSDYSXYLDXXXXX

SEQ ID NO: 307 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Lys is cyclized through side chain to form a lactam linkage
  MOD_RES 16: note = Glu is cyclized through side chain to form a lactam linkage
  MOD_RES 17: note = hArg
  MOD_RES 18: note = Lys(C20)
  MOD_RES 19..20: note = Aib
  REGION 1..20: note = C-term amide
HXQGTFTSDYSXYLDXXXXX

SEQ ID NO: 308 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C12)
  MOD_RES 19..20: note = Aib
  REGION 1..20: note = C-term amide
HXQGTFTSDYSXYLDXRXXX

SEQ ID NO: 309 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C14)
  MOD_RES 19..20: note = Aib
  REGION 1..20: note = C-term amide
HXQGTFTSDYSXYLDXRXXX

SEQ ID NO: 310 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C16)
  MOD_RES 19..20: note = Aib
  REGION 1..20: note = C-term amide
HXQGTFTSDYSXYLDXRXXX

SEQ ID NO: 311 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C18)
  MOD_RES 19..20: note = Aib
  REGION 1..20: note = C-term amide
HXQGTFTSDYSXYLDXRXXX

SEQ ID NO: 312 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 18: note = Lys(C20)
  MOD_RES 19..20: note = Aib
  REGION 1..20: note = C-term amide
HXQGTFTSDYSXYLDXRXXX

SEQ ID NO: 313 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C12)
  MOD_RES 19..20: note = Aib
  REGION 1..20: note = C-term amide
HXQGTFTSDYSXYLDXXXXX

SEQ ID NO: 314 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C14)
  MOD_RES 19..20: note = Aib
  REGION 1..20: note = C-term amide
HXQGTFTSDYSXYLDXXXXX

SEQ ID NO: 315 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C16)
  MOD_RES 19..20: note = Aib
  REGION 1..20: note = C-term amide
HXQGTFTSDYSXYLDXXXXX

SEQ ID NO: 316 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C18)
  MOD_RES 19..20: note = Aib
  REGION 1..20: note = C-term amide
HXQGTFTSDYSXYLDXXXXX

SEQ ID NO: 317 - protein, 20 aa, synthetic construct
  REGION 1..20: note = Synthetic peptide
  MOD_RES 2: note = Ac4c
  REGION 12..16: note = misc_feature - Cyclic
  MOD_RES 12: note = Glu is cyclized through side chain to form a lactam linkage
  MOD_RES 16: note = Lys is cyclized through side chain to form a lactam linkage
  MOD_RES 17: note = hArg
  MOD_RES 18: note = Lys(C20)
  MOD_RES 19..20: note = Aib
  REGION 1..20: note = C-term amide
HXQGTFTSDYSXYLDXXXXX

SEQ ID NO: 318 - protein, 20 aa, synthetic construct
  REGION 1..20: note = Synthetic peptide
  MOD_RES 2: note = Aib
  MOD_RES 16: note = Aib
  MOD_RES 18: note = Lys(C12)
  MOD_RES 19: note = Aib
  MOD_RES 20: note = Aib
  REGION 1..20: note = C-term amide
HXQGTFTSDYSKYLDXRXXX

SEQ ID NO: 319 - protein, 20 aa, synthetic construct
  REGION 1..20: note = Synthetic peptide
  MOD_RES 2: note = Aib
  MOD_RES 16: note = Aib
  MOD_RES 18: note = Lys(C14)
  MOD_RES 19: note = Aib
  MOD_RES 20: note = Aib
  REGION 1..20: note = C-term amide
HXQGTFTSDYSKYLDXRXXX

SEQ ID NO: 320 - protein, 20 aa, synthetic construct
  REGION 1..20: note = Synthetic peptide
  MOD_RES 2: note = Aib
  MOD_RES 16: note = Aib
  MOD_RES 18: note = Lys(C16)
  MOD_RES 19: note = Aib
  MOD_RES 20: note = Aib
  REGION 1..20: note = C-term amide
HXQGTFTSDYSKYLDXRXXX

SEQ ID NO: 321 - protein, 20 aa, synthetic construct
  REGION 1..20: note = Synthetic peptide
  MOD_RES 2: note = Aib
  MOD_RES 16: note = Aib
  MOD_RES 18: note = Lys(C18)
  MOD_RES 19: note = Aib
  MOD_RES 20: note = Aib
  REGION 1..20: note = C-term amide
HXQGTFTSDYSKYLDXRXXX

SEQ ID NO: 322 - protein, 20 aa, synthetic construct
  REGION 1..20: note = Synthetic peptide
  MOD_RES 2: note = Aib
  MOD_RES 16: note = Aib
  MOD_RES 18: note = Lys(C20)
  MOD_RES 19: note = Aib
  MOD_RES 20: note = Aib
  REGION 1..20: note = C-term amide
HXQGTFTSDYSKYLDXRXXX

SEQ ID NO: 323 - protein, 20 aa, synthetic construct
  REGION 1..20: note = Synthetic peptide
  MOD_RES 2: note = Aib
  MOD_RES 16: note = Aib
  MOD_RES 17: note = hArg
  MOD_RES 18: note = Lys(C12)
  MOD_RES 19: note = Aib
  MOD_RES 20: note = Aib
  REGION 1..20: note = C-term amide
HXQGTFTSDYSKYLDXXXXX

SEQ ID NO: 324 - protein, 20 aa, synthetic construct
  REGION 1..20: note = Synthetic peptide
  MOD_RES 2: note = Aib
  MOD_RES 16: note = Aib
  MOD_RES 17: note = hArg
  MOD_RES 18: note = Lys(C14)
  MOD_RES 19: note = Aib
  MOD_RES 20: note = Aib
  REGION 1..20: note = C-term amide
HXQGTFTSDYSKYLDXXXXX

SEQ ID NO: 325 - protein, 20 aa, synthetic construct
  REGION 1..20: note = Synthetic peptide
  MOD_RES 2: note = Aib
  MOD_RES 16: note = Aib
  MOD_RES 17: note = hArg
  MOD_RES 18: note = Lys(C16)
  MOD_RES 19: note = Aib
  MOD_RES 20: note = Aib
  REGION 1..20: note = C-term amide
HXQGTFTSDYSKYLDXXXXX

SEQ ID NO: 326 - protein, 20 aa, synthetic construct
  REGION 1..20: note = Synthetic peptide
  MOD_RES 2: note = Aib
  MOD_RES 16: note = Aib
  MOD_RES 17: note = hArg
  MOD_RES 18: note = Lys(C18)
  MOD_RES 19: note = Aib
  MOD_RES 20: note = Aib
  REGION 1..20: note = C-term amide
HXQGTFTSDYSKYLDXXXXX

SEQ ID NO: 327 - protein, 20 aa, synthetic construct
  REGION 1..20: note = Synthetic peptide
  MOD_RES 2: note = Aib
  MOD_RES 16: note = Aib
  MOD_RES 17: note = hArg
  MOD_RES 18: note = Lys(C20)
  MOD_RES 19: note = Aib
  MOD_RES 20: note = Aib
  REGION 1..20: note = C-term amide
HXQGTFTSDYSKYLDXXXXX

SEQ ID NO: 328 - protein, 19 aa, synthetic construct
  REGION 1..19: note = Synthetic peptide
  MOD_RES 2: note = Aib
  MOD_RES 16: note = Aib
  MOD_RES 18: note = Lys(C12)
  MOD_RES 19: note = Aib
  REGION 1..19: note = C-term amide
HXQGTFTSDYSKYLDXRXX

SEQ ID NO: 329 - protein, 19 aa, synthetic construct
  REGION 1..19: note = Synthetic peptide
  MOD_RES 2: note = Aib
  MOD_RES 16: note = Aib
  MOD_RES 18: note = Lys(C14)
  MOD_RES 19: note = Aib
  REGION 1..19: note = C-term amide
HXQGTFTSDYSKYLDXRXX

SEQ ID NO: 330 - protein, 19 aa, synthetic construct
  REGION 1..19: note = Synthetic peptide
  MOD_RES 2: note = Aib
  MOD_RES 16: note = Aib
  MOD_RES 18: note = Lys(C16)
  MOD_RES 19: note = Aib
  REGION 1..19: note = C-term amide
HXQGTFTSDYSKYLDXRXX

SEQ ID NO: 331 - protein, 19 aa, synthetic construct
  REGION 1..19: note = Synthetic peptide
  MOD_RES 2: note = Aib
  MOD_RES 16: note = Aib
  MOD_RES 18: note = Lys(C18)
  MOD_RES 19: note = Aib
  REGION 1..19: note = C-term amide
HXQGTFTSDYSKYLDXRXX

SEQ ID NO: 332 - protein, 19 aa, synthetic construct
  REGION 1..19: note = Synthetic peptide
  MOD_RES 2: note = Aib
  MOD_RES 16: note = Aib
  MOD_RES 18: note = Lys(C20)
  MOD_RES 19: note = Aib
  REGION 1..19: note = C-term amide
HXQGTFTSDYSKYLDXRXX

SEQ ID NO: 333 - protein, 19 aa, synthetic construct
  REGION 1..19: note = Synthetic peptide
  MOD_RES 2: note = Aib
  MOD_RES 16: note = Aib
  MOD_RES 17: note = hArg
  MOD_RES 18: note = Lys(C12)
  MOD_RES 19: note = Aib
  REGION 1..19: note = C-term amide
HXQGTFTSDYSKYLDXXXX

SEQ ID NO: 334 - protein, 19 aa, synthetic construct
  REGION 1..19: note = Synthetic peptide
  MOD_RES 2: note = Aib
  MOD_RES 16: note = Aib
  MOD_RES 17: note = hArg
  MOD_RES 18: note = Lys(C14)
  MOD_RES 19: note = Aib
  REGION 1..19: note = C-term amide
HXQGTFTSDYSKYLDXXXX

SEQ ID NO: 335 - protein, 19 aa, synthetic construct
  REGION 1..19: note = Synthetic peptide
  MOD_RES 2: note = Aib
  MOD_RES 16: note = Aib
  MOD_RES 17: note = hArg
  MOD_RES 18: note = Lys(C16)
  MOD_RES 19: note = Aib
  REGION 1..19: note = C-term amide
HXQGTFTSDYSKYLDXXXX

SEQ ID NO: 336 - protein, 19 aa, synthetic construct
  REGION 1..19: note = Synthetic peptide
  MOD_RES 2: note = Aib
  MOD_RES 16: note = Aib
  MOD_RES 17: note = hArg
  MOD_RES 18: note = Lys(C18)
  MOD_RES 19: note = Aib
  REGION 1..19: note = C-term amide
HXQGTFTSDYSKYLDXXXX

SEQ ID NO: 337 - protein, 19 aa, synthetic construct
  REGION 1..19: note = Synthetic peptide
  MOD_RES 2: note = Aib
  MOD_RES 16: note = Aib
  MOD_RES 17: note = hArg
  MOD_RES 18: note = Lys(C20)
  MOD_RES 19: note = Aib
  REGION 1..19: note = C-term amide
HXQGTFTSDYSKYLDXXXX

SEQ ID NO: 338 - protein, 19 aa, synthetic construct
  REGION 1..19: note = Synthetic peptide
  MOD_RES 2: note = Ac3c
  MOD_RES 16: note = Aib
  MOD_RES 17: note = hArg
  MOD_RES 18: note = Lys(C12)
  MOD_RES 19: note = Aib
  REGION 1..19: note = C-term amide
HXQGTFTSDYSKYLDXXXX

SEQ ID NO: 339 - protein, 18 aa, synthetic construct
  REGION 1..18: note = Synthetic peptide
  MOD_RES 2: note = Aib
  MOD_RES 18: note = Lys(C12)
  REGION 1..18: note = C-term amide
HXQGTFTSDYSKYLDSRX

SEQ ID NO: 340 - protein, 18 aa, synthetic construct
  REGION 1..18: note = Synthetic peptide
  MOD_RES 2: note = Aib
  MOD_RES 17: note = hArg
  MOD_RES 18: note = Lys(C12)
  REGION 1..18: note = C-term amide
HXQGTFTSDYSKYLDSXX

SEQ ID NO: 341 - protein, 18 aa, synthetic construct
  REGION 1..18: note = Synthetic peptide
  MOD_RES 2: note = Aib
  MOD_RES 16: note = Aib
  MOD_RES 18: note = Lys(C12)
  REGION 1..18: note = C-term amide
HXQGTFTSDYSKYLDXRX

SEQ ID NO: 342 - protein, 18 aa, synthetic construct
  REGION 1..18: note = Synthetic peptide
  MOD_RES 2: note = Aib
  MOD_RES 16: note = Aib
  MOD_RES 17: note = hArg
  MOD_RES 18: note = Lys(C12)
  REGION 1..18: note = C-term amide
HXQGTFTSDYSKYLDXXX

SEQ ID NO: 343 - protein, 18 aa, synthetic construct
  REGION 1..18: note = Synthetic peptide
  MOD_RES 2: note = Ac4c
  MOD_RES 16: note = Aib
  MOD_RES 18: note = Lys(C12)
  REGION 1..18: note = C-term amide
HXQGTFTSDYSKYLDXRX

SEQ ID NO: 344 - protein, 19 aa, synthetic construct
  REGION 1..19: note = Synthetic peptide
  MOD_RES 2: note = Ac4c
  MOD_RES 16: note = Aib
  MOD_RES 18: note = Lys(C12)
  MOD_RES 19: note = Aib
  REGION 1..19: note = C-term amide
HXQGTFTSDYSKYLDXRXX

SEQ ID NO: 345 - protein, 18 aa, synthetic construct
  REGION 1..18: note = Synthetic peptide
  MOD_RES 2: note = Ac4c
  MOD_RES 16: note = Aib
  MOD_RES 17: note = hArg
  MOD_RES 18: note = Lys(C12)
  REGION 1..18: note = C-term amide
HXQGTFTSDYSKYLDXXX

SEQ ID NO: 346 - protein, 18 aa, synthetic construct
  REGION 1..18: note = Synthetic peptide
  MOD_RES 2: note = Ac4c
  MOD_RES 16: note = Aib
  MOD_RES 17: note = hArg
  MOD_RES 18: note = Lys(C14)
  REGION 1..18: note = C-term amide
HXQGTFTSDYSKYLDXXX

SEQ ID NO: 347 - protein, 18 aa, synthetic construct
  REGION 1..18: note = Synthetic peptide
  MOD_RES 2: note = Ac4c
  MOD_RES 16: note = Aib
  MOD_RES 17: note = hArg
  MOD_RES 18: note = Lys(C16)
  REGION 1..18: note = C-term amide
HXQGTFTSDYSKYLDXXX

SEQ ID NO: 348 - protein, 18 aa, synthetic construct
  REGION 1..18: note = Synthetic peptide
  MOD_RES 2: note = Ac4c
  MOD_RES 16: note = Aib
  MOD_RES 17: note = hArg
  MOD_RES 18: note = Lys(C18)
  REGION 1..18: note = C-term amide
HXQGTFTSDYSKYLDXXX

SEQ ID NO: 349 - protein, 18 aa, synthetic construct
  REGION 1..18: note = Synthetic peptide
  MOD_RES 2: note = Aib
  REGION 10..14: note = misc_feature - Cyclic
  MOD_RES 10: note = Glu is cyclized through side chain to form a lactam linkage
  MOD_RES 14: note = Lys is cyclized through side chain to form a lactam linkage
  MOD_RES 18: note = Lys(C12)
  REGION 1..18: note = C-term amide
HXQGTFTSDXSKYXDSRX

SEQ ID NO: 350 - protein, 18 aa, synthetic construct
  REGION 1..18: note = Synthetic peptide
  MOD_RES 2: note = Ac4c
  REGION 10..14: note = misc_feature - Cyclic
  MOD_RES 10: note = Glu is cyclized through side chain to form a lactam linkage
  MOD_RES 14: note = Lys is cyclized through side chain to form a lactam linkage
  MOD_RES 16: note = Aib
  MOD_RES 17: note = hArg
  MOD_RES 18: note = Lys(C14)
  REGION 1..18: note = C-term amide
HXQGTFTSDXSKYKDXXX

SEQ ID NO: 351 - protein, 18 aa, synthetic construct
  REGION 1..18: note = Synthetic peptide
  MOD_RES 2: note = Aib
  REGION 13..17: note = misc_feature - Cyclic
  MOD_RES 13: note = Glu is cyclized through side chain to form a lactam linkage
  MOD_RES 17: note = Lys is cyclized through side chain to form a lactam linkage
  MOD_RES 18: note = Lys(C12)
  REGION 1..18: note = C-term amide
HXQGTFTSDYSKXLDSXX

SEQ ID NO: 352 - protein, 20 aa, synthetic construct
  REGION 1..20: note = Synthetic peptide
  MOD_RES 2: note = Aib
  REGION 17..20: note = misc_feature - Cyclic
  MOD_RES 17: note = Glu is cyclized through side chain to form a lactam linkage
  MOD_RES 18: note = Lys(C12)
  MOD_RES 20: note = Lys is cyclized through side chain to form a lactam linkage
  REGION 1..20: note = C-term amide
HXQGTFTSDYSKYLDSXXAX

SEQ ID NO: 353 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C12)
  MOD_RES 21: note = Lys is cyclized through side chain to form a lactam linkage
  REGION 1..21: note = C-term amide
HXQGTFTSDYSKYLDSXXARX

SEQ ID NO: 354 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C14)
  MOD_RES 21: note = Lys is cyclized through side chain to form a lactam linkage
  REGION 1..21: note = C-term amide
HXQGTFTSDYSKYLDSXXARX

SEQ ID NO: 355 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C16)
  MOD_RES 21: note = Lys is cyclized through side chain to form a lactam linkage
  REGION 1..21: note = C-term amide
HXQGTFTSDYSKYLDSXXARX

SEQ ID NO: 356 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C18)
  MOD_RES 21: note = Lys is cyclized through side chain to form a lactam linkage
  REGION 1..21: note = C-term amide
HXQGTFTSDYSKYLDSXXARX

SEQ ID NO: 357 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C20)
  MOD_RES 21: note = Lys is cyclized through side chain to form a lactam linkage
  REGION 1..21: note = C-term amide
HXQGTFTSDYSKYLDSXXARX

SEQ ID NO: 358 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C12)
  MOD_RES 21: note = Lys is cyclized through side chain to form a lactam linkage
  REGION 1..21: note = C-term amide
HXQGTFTSDYSKYLDSXXAQX

SEQ ID NO: 359 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C14)
  MOD_RES 21: note = Lys is cyclized through side chain to form a lactam linkage
  REGION 1..21: note = C-term amide
HXQGTFTSDYSKYLDSXXAQX

SEQ ID NO: 360 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C16)
  MOD_RES 21: note = Lys is cyclized through side chain to form a lactam linkage
  REGION 1..21: note = C-term amide
HXQGTFTSDYSKYLDSXXAQX

SEQ ID NO: 361 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C18)
  MOD_RES 21: note = Lys is cyclized through side chain to form a lactam linkage
  REGION 1..21: note = C-term amide
HXQGTFTSDYSKYLDSXXAQX

SEQ ID NO: 362 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C20)
  MOD_RES 21: note = Lys is cyclized through side chain to form a lactam linkage
  REGION 1..21: note = C-term amide
HXQGTFTSDYSKYLDSXXAQX

SEQ ID NO: 363 - protein, 21 aa, synthetic construct
  REGION 1..21: note = Synthetic peptide
  MOD_RES 2: note = Aib
  REGION 17..21: note = misc_feature - Cyclic
  MOD_RES 17: note = Glu is cyclized through side chain to form a lactam linkage
  MOD_RES 18: note = Lys(C12)
  MOD_RES 21: note = Lys is cyclized through side chain to form a lactam linkage
  REGION 1..21: note = C-term amide
HXQGTFTSDYSKYLDSXXVRX

SEQ ID NO: 364 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 11: note = Lys(C8)
  REGION 1..11: note = C-term amide
HXQGTXTSDYX

SEQ ID NO: 365 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 11: note = Lys(C14)
  REGION 1..11: note = C-term amide
HXQGTXTSDYX

SEQ ID NO: 366 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 11: note = Lys(C16)
  REGION 1..11: note = C-term amide
HXQGTXTSDYX

SEQ ID NO: 367 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 11: note = Lys(C20)
  REGION 1..11: note = C-term amide
HXQGTXTSDYX

SEQ ID NO: 368 - protein, 11 aa, synthetic construct
  REGION 1..11: note = Synthetic peptide
  MOD_RES 2: note = Aib
  MOD_RES 11: note = Lys(C12)
  REGION 1..11: note = C-term amide
HXQGTFTSDYX

SEQ ID NO: 369 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 11: note = Lys(C12)
  REGION 1..11: note = C-term amide
HXQGTXTSDYX

SEQ ID NO: 370 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 11: note = Lys(C18)
  REGION 1..11: note = C-term amide
HXQGTXTSDYX

SEQ ID NO: 371 - protein, 11 aa, synthetic construct
  REGION 1..11: note = Synthetic peptide
  MOD_RES 2: note = Alpha-MePro
  MOD_RES 11: note = Lys(C12)
  REGION 1..11: note = C-term amide
HXQGTFTSDYX

SEQ ID NO: 372 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 11: note = Lys(C12)
  REGION 1..11: note = C-term amide
HXQGTXTSDYX

SEQ ID NO: 373 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Lys(C12)
  REGION 1..11: note = C-term amide
HXQGTXTSDXX

SEQ ID NO: 374 - protein, 11 aa, synthetic construct
  REGION 1..11: note = Synthetic peptide
  MOD_RES 2: note = Aib
  MOD_RES 10: note = Bip
  MOD_RES 11: note = Lys(C12)
  REGION 1..11: note = C-term amide
HXQGTFTSDXX

SEQ ID NO: 375 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Lys(C18)
  REGION 1..11: note = C-term amide
HXQGTXTSDXX

SEQ ID NO: 376 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 11: note = Lys(C8)
  REGION 1..11: note = C-term amide
HXQGTXTSDYX

SEQ ID NO: 377 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 11: note = Lys(16)
  REGION 1..11: note = C-term amide
HXQGTXTSDYX

SEQ ID NO: 378 - protein, 29 aa, synthetic construct
  REGION 1..29: note = Synthetic peptide
  MOD_RES 17: note = Lys(C8)
  REGION 1..29: note = C-term amide
HGQGTFTSDYSKYLDEXAAREFIAWLLNT

SEQ ID NO: 379 - protein, 29 aa, synthetic construct
  REGION 1..29: note = Synthetic peptide
  MOD_RES 17: note = Lys(C12)
  REGION 1..29: note = C-term amide
HGQGTFTSDYSKYLDEXAAREFIAWLLNT

SEQ ID NO: 380 - protein, 29 aa, synthetic construct
  REGION 1..29: note = Synthetic peptide
  MOD_RES 17: note = Lys(C14)
  REGION 1..29: note = C-term amide
HGQGTFTSDYSKYLDEXAAREFIAWLLNT

SEQ ID NO: 381 - protein, 29 aa, synthetic construct
  REGION 1..29: note = Synthetic peptide
  MOD_RES 17: note = Lys(C16)
  REGION 1..29: note = C-term amide
HGQGTFTSDYSKYLDEXAAREFIAWLLNT

SEQ ID NO: 382 - protein, 29 aa, synthetic construct
  REGION 1..29: note = Synthetic peptide
  MOD_RES 17: note = Lys(C18)
  REGION 1..29: note = C-term amide
HGQGTFTSDYSKYLDEXAAREFIAWLLNT

SEQ ID NO: 383 - protein, 29 aa, synthetic construct
  REGION 1..29: note = Synthetic peptide
  MOD_RES 17: note = Lys(C20)
  REGION 1..29: note = C-term amide
HGQGTFTSDYSKYLDEXAAREFIAWLLNT

SEQ ID NO: 384 - protein, 29 aa, synthetic construct
  REGION 1..29: note = Synthetic peptide
  MOD_RES 17: note = Lys(C8)
  REGION 1..29: note = C-term amide
HGQGTFTSDYSKYLDEXAAKEFIAWLLNT

SEQ ID NO: 385 - protein, 29 aa, synthetic construct
  REGION 1..29: note = Synthetic peptide
  MOD_RES 17: note = Lys(C14)
  REGION 1..29: note = C-term amide
HGQGTFTSDYSKYLDEXAAKEFIAWLLNT

SEQ ID NO: 386 - protein, 29 aa, synthetic construct
  REGION 1..29: note = Synthetic peptide
  MOD_RES 17: note = Lys(C16)
  REGION 1..29: note = C-term amide
HGQGTFTSDYSKYLDEXAAKEFIAWLLNT

SEQ ID NO: 387 - protein, 29 aa, synthetic construct
  REGION 1..29: note = Synthetic peptide
  MOD_RES 17: note = Lys(C20)
  REGION 1..29: note = C-term amide
HGQGTFTSDYSKYLDEXAAKEFIAWLLNT

SEQ ID NO: 388 - protein, 29 aa, synthetic construct
  REGION 1..29: note = Synthetic peptide
  REGION 1..29: note = C-term amide
HGQGTFTSDYSKYLDEKAAKEFIAWLLNT

SEQ ID NO: 389 - protein, 29 aa, synthetic construct
  REGION 1..29: note = Synthetic peptide
  MOD_RES 17: note = Lys(C12)
  REGION 1..29: note = C-term amide
HGQGTFTSDYSKYLDEXAAKEFIAWLLNT

SEQ ID NO: 390 - protein, 29 aa, synthetic construct
  REGION 1..29: note = Synthetic peptide
  MOD_RES 17: note = Lys(C18)
  REGION 1..29: note = C-term amide
HGQGTFTSDYSKYLDEXAAKEFIAWLLNT

SEQ ID NO: 391 - protein, 29 aa, synthetic construct
  REGION 1..29: note = Synthetic peptide
  MOD_RES 2: note = Aib
  MOD_RES 17: note = Lys(C18)
  REGION 1..29: note = C-term amide
HXQGTFTSDYSKYLDEXAAKEFIAWLLNT

SEQ ID NO: 392 - protein, 29 aa, synthetic construct
  REGION 1..29: note = Synthetic peptide
  REGION 1..29: note = C-term amide
HGQGTFTSDYSKYLDERRAKDFVQWLLNT

SEQ ID NO: 393 - protein, 29 aa, synthetic construct
  REGION 1..29: note = Synthetic peptide
  MOD_RES 20: note = Lys(C12)
  REGION 1..29: note = C-term amide
HGQGTFTSDYSKYLDERRAXDFVQWLLNT

SEQ ID NO: 394 - protein, 29 aa, synthetic construct
  REGION 1..29: note = Synthetic peptide
  MOD_RES 20: note = Lys(C18)
  REGION 1..29: note = C-term amide
HGQGTFTSDYSKYLDERRAXDFVQWLLNT

SEQ ID NO: 395 - protein, 29 aa, synthetic construct
  REGION 1..29: note = Synthetic peptide
  MOD_RES 2: note = Aib
  MOD_RES 20: note = Lys(C18)
  REGION 1..29: note = C-term amide
HXQGTFTSDYSKYLDERRAXDFVQWLLNT

SEQ ID NO: 396 - protein, 29 aa, synthetic construct
  REGION 1..29: note = Synthetic peptide
  MOD_RES 2: note = Aib
  MOD_RES 20: note = Lys(C8)
  REGION 1..29: note = C-term amide
HXQGTFTSDYSKYLDERRAXDFVQWLLNT

SEQ ID NO: 397 - protein, 29 aa, synthetic construct
  REGION 1..29: note = Synthetic peptide
  MOD_RES 2: note = Aib
  MOD_RES 20: note = Lys(C12)
  REGION 1..29: note = C-term amide
HXQGTFTSDYSKYLDERRAXDFVQWLLNT

SEQ ID NO: 398 - protein, 29 aa, synthetic construct
  REGION 1..29: note = Synthetic peptide
  MOD_RES 2: note = Aib
  MOD_RES 20: note = Lys(C14)
  REGION 1..29: note = C-term amide
HXQGTFTSDYSKYLDERRAXDFVQWLLNT

SEQ ID NO: 399 - protein, 29 aa, synthetic construct
  REGION 1..29: note = Synthetic peptide
  MOD_RES 2: note = Aib
  MOD_RES 20: note = Lys(C16)
  REGION 1..29: note = C-term amide
HXQGTFTSDYSKYLDERRAXDFVQWLLNT

SEQ ID NO: 400 - protein, 29 aa, synthetic construct
  REGION 1..29: note = Synthetic peptide
  MOD_RES 2: note = Aib
  MOD_RES 20: note = Lys(C18)
  REGION 1..29: note = C-term amide
HXQGTFTSDYSKYLDERRAXDFVQWLLNT

SEQ ID NO: 401 - protein, 29 aa, synthetic construct
  REGION 1..29: note = Synthetic peptide
  MOD_RES 2: note = Aib
  MOD_RES 20: note = Lys(C20)
  REGION 1..29: note = C-term amide
HXQGTFTSDYSKYLDERRAXDFVQWLLNT

SEQ ID NO: 402 - protein, 29 aa, synthetic construct
  REGION 1..29: note = Synthetic peptide
  MOD_RES 20: note = Lys(C8)
  REGION 1..29: note = C-term amide
HGQGTFTSDYSKYLDERRAXDFVQWLLNT

SEQ ID NO: 403 - protein, 29 aa, synthetic construct
  REGION 1..29: note = Synthetic peptide
  MOD_RES 20: note = Lys(C12)
  REGION 1..29: note = C-term amide
HGQGTFTSDYSKYLDERRAXDFVQWLLNT

SEQ ID NO: 404 - protein, 29 aa, synthetic construct
  REGION 1..29: note = Synthetic peptide
  MOD_RES 20: note = Lys(C14)
  REGION 1..29: note = C-term amide
HGQGTFTSDYSKYLDERRAXDFVQWLLNT

SEQ ID NO: 405 - protein, 29 aa, synthetic construct
  REGION 1..29: note = Synthetic peptide
  MOD_RES 20: note = Lys(C16)
  REGION 1..29: note = C-term amide
HGQGTFTSDYSKYLDERRAXDFVQWLLNT

SEQ ID NO: 406 - protein, 29 aa, synthetic construct
  REGION 1..29: note = Synthetic peptide
  MOD_RES 20: note = Lys(C18)
  REGION 1..29: note = C-term amide
HGQGTFTSDYSKYLDERRAXDFVQWLLNT

SEQ ID NO: 407 - protein, 29 aa, synthetic construct
  REGION 1..29: note = Synthetic peptide
  MOD_RES 20: note = Lys(C20)
  REGION 1..29: note = C-term amide
HGQGTFTSDYSKYLDERRAXDFVQWLLNT

SEQ ID NO: 408 - protein, 29 aa, synthetic construct
  REGION 1..29: note = Synthetic peptide
  MOD_RES 2: note = Aib
  MOD_RES 17: note = Lys(C8)
  REGION 1..29: note = C-term amide
HXQGTFTSDYSKYLDEXAAKEFIAWLLNT

SEQ ID NO: 409 - protein, 29 aa, synthetic construct
  REGION 1..29: note = Synthetic peptide
  MOD_RES 2: note = Aib
  MOD_RES 17: note = Lys(C12)
  REGION 1..29: note = C-term amide
HXQGTFTSDYSKYLDEXAAKEFIAWLLNT

SEQ ID NO: 410 - protein, 29 aa, synthetic construct
  REGION 1..29: note = Synthetic peptide
  MOD_RES 2: note = Aib
  MOD_RES 17: note = Lys(C14)
  REGION 1..29: note = C-term amide
HXQGTFTSDYSKYLDEXAAKEFIAWLLNT

SEQ ID NO: 411 - protein, 29 aa, synthetic construct
  REGION 1..29: note = Synthetic peptide
  MOD_RES 2: note = Aib
  MOD_RES 17: note = Lys(C16)
  REGION 1..29: note = C-term amide
HXQGTFTSDYSKYLDEXAAKEFIAWLLNT

SEQ ID NO: 412 - protein, 29 aa, synthetic construct
  REGION 1..29: note = Synthetic peptide
  MOD_RES 2: note = Aib
  MOD_RES 17: note = Lys(C18)
  REGION 1..29: note = C-term amide
HXQGTFTSDYSKYLDEXAAKEFIAWLLNT

SEQ ID NO: 413 - protein, 29 aa, synthetic construct
  REGION 1..29: note = Synthetic peptide
  MOD_RES 2: note = Aib
  MOD_RES 17: note = Lys(C20)
  REGION 1..29: note = C-term amide
HXQGTFTSDYSKYLDEXAAKEFIAWLLNT

SEQ ID NO: 414 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C8)
  REGION 1..29: note = C-term amide
HXQGTFTSDYSKYLDXQAAXEFIXWLMNT

SEQ ID NO: 415 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C12)
  REGION 1..29: note = C-term amide
HXQGTFTSDYSKYLDXQAAXEFIXWLMNT

SEQ ID NO: 416 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C14)
  REGION 1..29: note = C-term amide
HXQGTFTSDYSKYLDXQAAXEFIXWLMNT

SEQ ID NO: 417 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C16)
  REGION 1..29: note = C-term amide
HXQGTFTSDYSKYLDXQAAXEFIXWLMNT

SEQ ID NO: 418 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C18)
  REGION 1..29: note = C-term amide
HXQGTFTSDYSKYLDXQAAXEFIXWLMNT

SEQ ID NO: 419 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C20)
  REGION 1..29: note = C-term amide
HXQGTFTSDYSKYLDXQAAXEFIXWLMNT

SEQ ID NO: 420 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C8)
  REGION 1..29: note = C-term amide
HXQGTFTSDYSKYLDXQAAXEFIXWLLNT

SEQ ID NO: 421 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C12)
  REGION 1..29: note = C-term amide
HXQGTFTSDYSKYLDXQAAXEFIXWLLNT

SEQ ID NO: 422 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C14)
  REGION 1..29: note = C-term amide
HXQGTFTSDYSKYLDXQAAXEFIXWLLNT

SEQ ID NO: 423 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C16)
  REGION 1..29: note = C-term amide
HXQGTFTSDYSKYLDXQAAXEFIXWLLNT

SEQ ID NO: 424 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C18)
  REGION 1..29: note = C-term amide
HXQGTFTSDYSKYLDXQAAXEFIXWLLNT

SEQ ID NO: 425 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C20)
  REGION 1..29: note = C-term amide
HXQGTFTSDYSKYLDXQAAXEFIXWLLNT

SEQ ID NO: 426 - protein, 29 aa, synthetic construct
  REGION 1..29: note = Synthetic peptide
  MOD_RES 24: note = Lys(C8)
  REGION 1..29: note = C-term amide
HGQGTFTSDYSKYLDEQAAREFIXWLLNT

SEQ ID NO: 427 - protein, 29 aa, synthetic construct
  REGION 1..29: note = Synthetic peptide
  MOD_RES 24: note = Lys(C12)
  REGION 1..29: note = C-term amide
HGQGTFTSDYSKYLDEQAAREFIXWLLNT

SEQ ID NO: 428 - protein, 29 aa, synthetic construct
  REGION 1..29: note = Synthetic peptide
  MOD_RES 24: note = Lys(C14)
  REGION 1..29: note = C-term amide
HGQGTFTSDYSKYLDEQAAREFIXWLLNT

SEQ ID NO: 429 - protein, 29 aa, synthetic construct
  REGION 1..29: note = Synthetic peptide
  MOD_RES 24: note = Lys(C16)
  REGION 1..29: note = C-term amide
HGQGTFTSDYSKYLDEQAAREFIXWLLNT

SEQ ID NO: 430 - protein, 29 aa, synthetic construct
  REGION 1..29: note = Synthetic peptide
  MOD_RES 24: note = Lys(C18)
  REGION 1..29: note = C-term amide
HGQGTFTSDYSKYLDEQAAREFIXWLLNT

SEQ ID NO: 431 - protein, 29 aa, synthetic construct
  REGION 1..29: note = Synthetic peptide
  MOD_RES 24: note = Lys(C20)
  REGION 1..29: note = C-term amide
HGQGTFTSDYSKYLDEQAAREFIXWLLNT

SEQ ID NO: 432 - protein, 29 aa, synthetic construct
  REGION 1..29: note = Synthetic peptide
  MOD_RES 2: note = Aib
  MOD_RES 17: note = Lys(C8)
  REGION 1..29: note = C-term amide
HXQGTFTSDYSKYLDEXAAREFIAWLLNT

SEQ ID NO: 433 - protein, 29 aa, synthetic construct
  REGION 1..29: note = Synthetic peptide
  MOD_RES 2: note = Aib
  MOD_RES 17: note = Lys(C12)
  REGION 1..29: note = C-term amide
HXQGTFTSDYSKYLDEXAAREFIAWLLNT

SEQ ID NO: 434 - protein, 29 aa, synthetic construct
  REGION 1..29: note = Synthetic peptide
  MOD_RES 2: note = Aib
  MOD_RES 17: note = Lys(C14)
  REGION 1..29: note = C-term amide
HXQGTFTSDYSKYLDEXAAREFIAWLLNT

SEQ ID NO: 435 - protein, 29 aa, synthetic construct
  REGION 1..29: note = Synthetic peptide
  MOD_RES 2: note = Aib
  MOD_RES 17: note = Lys(C16)
  REGION 1..29: note = C-term amide
HXQGTFTSDYSKYLDEXAAREFIAWLLNT

SEQ ID NO: 436 - protein, 29 aa, synthetic construct
  REGION 1..29: note = Synthetic peptide
  MOD_RES 2: note = Aib
  MOD_RES 17: note = Lys(C18)
  REGION 1..29: note = C-term amide
HXQGTFTSDYSKYLDEXAAREFIAWLLNT

SEQ ID NO: 437 - protein, 29 aa, synthetic construct
  REGION 1..29: note = Synthetic peptide
  MOD_RES 2: note = Aib
  MOD_RES 17: note = Lys(C20)
  REGION 1..29: note = C-term amide
HXQGTFTSDYSKYLDEXAAREFIAWLLNT

SEQ ID NO: 438 - protein, 29 aa, synthetic construct
  REGION 1..29: note = Synthetic peptide
  MOD_RES 24: note = Lys(C8)
  REGION 1..29: note = C-term amide
HGQGTFTSDYSKYLDERRAQDFVXWLLNT

SEQ ID NO: 439 - protein, 29 aa, synthetic construct
  REGION 1..29: note = Synthetic peptide
  MOD_RES 24: note = Lys(C12)
  REGION 1..29: note = C-term amide
HGQGTFTSDYSKYLDERRAQDFVXWLLNT

SEQ ID NO: 440 - protein, 29 aa, synthetic construct
  REGION 1..29: note = Synthetic peptide
  MOD_RES 24: note = Lys(C14)
  REGION 1..29: note = C-term amide
HGQGTFTSDYSKYLDERRAQDFVXWLLNT

SEQ ID NO: 441 - protein, 29 aa, synthetic construct
  REGION 1..29: note = Synthetic peptide
  MOD_RES 24: note = Lys(C16)
  REGION 1..29: note = C-term amide
HGQGTFTSDYSKYLDERRAQDFVXWLLNT

SEQ ID NO: 442 - protein, 29 aa, synthetic construct
  REGION 1..29: note = Synthetic peptide
  MOD_RES 24: note = Lys(C18)
  REGION 1..29: note = C-term amide
HGQGTFTSDYSKYLDERRAQDFVXWLLNT

SEQ ID NO: 443 - protein, 29 aa, synthetic construct
  REGION 1..29: note = Synthetic peptide
  MOD_RES 24: note = Lys(C20)
  REGION 1..29: note = C-term amide
HGQGTFTSDYSKYLDERRAQDFVXWLLNT

SEQ ID NO: 444 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Lys(C8)
  REGION 1..11: note = C-term amide
HXQGTXTSDXX

SEQ ID NO: 445 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Lys(C12)
  REGION 1..11: note = C-term amide
HXQGTXTSDXX

SEQ ID NO: 446 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Lys(C14)
  REGION 1..11: note = C-term amide
HXQGTXTSDXX

SEQ ID NO: 447 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Lys(C16)
  REGION 1..11: note = C-term amide
HXQGTXTSDXX

SEQ ID NO: 448 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Lys(C18)
  REGION 1..11: note = C-term amide
HXQGTXTSDXX

SEQ ID NO: 449 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Lys(C20)
  REGION 1..11: note = C-term amide
HXQGTXTSDXX

SEQ ID NO: 450 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Lys(C8)
  REGION 1..11: note = C-term amide
HXQGTXTSDXX

SEQ ID NO: 451 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Lys(C12)
  REGION 1..11: note = C-term amide
HXQGTXTSDXX

SEQ ID NO: 452 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Lys(C14)
  REGION 1..11: note = C-term amide
HXQGTXTSDXX

SEQ ID NO: 453 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Lys(C16)
  REGION 1..11: note = C-term amide
HXQGTXTSDXX

SEQ ID NO: 454 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Lys(C18)
  REGION 1..11: note = C-term amide
HXQGTXTSDXX

SEQ ID NO: 455 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Lys(C20)
  REGION 1..11: note = C-term amide
HXQGTXTSDXX

SEQ ID NO: 456 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Lys(C8)
  REGION 1..11: note = C-term amide
HXQGTXTSDXX

SEQ ID NO: 457 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Lys(C12)
  REGION 1..11: note = C-term amide
HXQGTXTSDXX

SEQ ID NO: 458 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Lys(C14)
  REGION 1..11: note = C-term amide
HXQGTXTSDXX

SEQ ID NO: 459 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Lys(C16)
  REGION 1..11: note = C-term amide
HXQGTXTSDXX

SEQ ID NO: 460 - protein, 29 aa, synthetic construct
  REGION 1..29: note = Synthetic peptide
  MOD_RES 17: note = Lys(C16)
  REGION 1..29: note = C-term amide
HGQGTFTSDYSKYLDAXAAREFIAWLLNT

SEQ ID NO: 461 - protein, 29 aa, synthetic construct
  REGION 1..29: note = Synthetic peptide
  MOD_RES 17: note = Lys(C18)
  REGION 1..29: note = C-term amide
HGQGTFTSDYSKYLDAXAAREFIAWLLNT

SEQ ID NO: 462 - protein, 29 aa, synthetic construct
  REGION 1..29: note = Synthetic peptide
  MOD_RES 17: note = Lys(C20)
  REGION 1..29: note = C-term amide
HGQGTFTSDYSKYLDAXAAREFIAWLLNT

SEQ ID NO: 463 - protein, 29 aa, synthetic construct
  REGION 1..29: note = Synthetic peptide
  MOD_RES 17: note = Lys(C8)
  REGION 1..29: note = C-term amide
HGQGTFTSDYSKYLDAXAAKEFIAWLLNT

SEQ ID NO: 464 - protein, 29 aa, synthetic construct
  REGION 1..29: note = Synthetic peptide
  MOD_RES 17: note = Lys(C12)
  REGION 1..29: note = C-term amide
HGQGTFTSDYSKYLDAXAAKEFIAWLLNT

SEQ ID NO: 465 - protein, 29 aa, synthetic construct
  REGION 1..29: note = Synthetic peptide
  MOD_RES 17: note = Lys(C14)
  REGION 1..29: note = C-term amide
HGQGTFTSDYSKYLDAXAAKEFIAWLLNT

SEQ ID NO: 466 - protein, 29 aa, synthetic construct
  REGION 1..29: note = Synthetic peptide
  MOD_RES 17: note = Lys(C16)
  REGION 1..29: note = C-term amide
HGQGTFTSDYSKYLDAXAAKEFIAWLLNT

SEQ ID NO: 467 - protein, 29 aa, synthetic construct
  REGION 1..29: note = Synthetic peptide
  MOD_RES 17: note = Lys(C18)
  REGION 1..29: note = C-term amide
HGQGTFTSDYSKYLDAXAAKEFIAWLLNT

SEQ ID NO: 468 - protein, 29 aa, synthetic construct
  REGION 1..29: note = Synthetic peptide
  MOD_RES 17: note = Lys(C20)
  REGION 1..29: note = C-term amide
HGQGTFTSDYSKYLDAXAAKEFIAWLLNT

SEQ ID NO: 469 - protein, 29 aa, synthetic construct
  REGION 1..29: note = Synthetic peptide
  MOD_RES 16: note = Aib
  MOD_RES 17: note = Lys(C8)
  REGION 1..29: note = C-term amide
HGQGTFTSDYSKYLDXXAAKEFIAWLLNT

SEQ ID NO: 470 - protein, 29 aa, synthetic construct
  REGION 1..29: note = Synthetic peptide
  MOD_RES 16: note = Aib
  MOD_RES 17: note = Lys(C12)
  REGION 1..29: note = C-term amide
HGQGTFTSDYSKYLDXXAAKEFIAWLLNT

SEQ ID NO: 471 - protein, 29 aa, synthetic construct
  REGION 1..29: note = Synthetic peptide
  MOD_RES 16: note = Aib
  MOD_RES 17: note = Lys(C14)
  REGION 1..29: note = C-term amide
HGQGTFTSDYSKYLDXXAAKEFIAWLLNT

SEQ ID NO: 472 - protein, 29 aa, synthetic construct
  REGION 1..29: note = Synthetic peptide
  MOD_RES 16: note = Aib
  MOD_RES 17: note = Lys(C16)
  REGION 1..29: note = C-term amide
HGQGTFTSDYSKYLDXXAAKEFIAWLLNT

SEQ ID NO: 473 - protein, 29 aa, synthetic construct
  REGION 1..29: note = Synthetic peptide
  MOD_RES 16: note = Aib
  MOD_RES 17: note = Lys(C18)
  REGION 1..29: note = C-term amide
HGQGTFTSDYSKYLDXXAAKEFIAWLLNT

SEQ ID NO: 474 - protein, 29 aa, synthetic construct
  REGION 1..29: note = Synthetic peptide
  MOD_RES 16: note = Aib
  MOD_RES 17: note = Lys(C20)
  REGION 1..29: note = C-term amide
HGQGTFTSDYSKYLDXXAAKEFIAWLLNT

SEQ ID NO: 475 - protein, 29 aa, synthetic construct
  REGION 1..29: note = Synthetic peptide
  MOD_RES 16: note = Aib
  MOD_RES 17: note = Lys(C8)
  REGION 1..29: note = C-term amide
HGQGTFTSDYSKYLDXXAAREFIAWLLNT

SEQ ID NO: 476 - protein, 29 aa, synthetic construct
  REGION 1..29: note = Synthetic peptide
  MOD_RES 16: note = Aib
  MOD_RES 17: note = Lys(C12)
  REGION 1..29: note = C-term amide
HGQGTFTSDYSKYLDXXAAREFIAWLLNT

SEQ ID NO: 477 - protein, 29 aa, synthetic construct
  REGION 1..29: note = Synthetic peptide
  MOD_RES 16: note = Aib
  MOD_RES 17: note = Lys(C14)
  REGION 1..29: note = C-term amide
HGQGTFTSDYSKYLDXXAAREFIAWLLNT

SEQ ID NO: 478 - protein, 29 aa, synthetic construct
  REGION 1..29: note = Synthetic peptide
  MOD_RES 16: note = Aib
  MOD_RES 17: note = Lys(C16)
  REGION 1..29: note = C-term amide
HGQGTFTSDYSKYLDXXAAREFIAWLLNT

SEQ ID NO: 479 - protein, 29 aa, synthetic construct
  REGION 1..29: note = Synthetic peptide
  MOD_RES 16: note = Aib
  MOD_RES 17: note = Lys(C18)
  REGION 1..29: note = C-term amide
HGQGTFTSDYSKYLDXXAAREFIAWLLNT

SEQ ID NO: 480 - protein, 29 aa, synthetic construct
  REGION 1..29: note = Synthetic peptide
  MOD_RES 16: note = Aib
  MOD_RES 17: note = Lys(C20)
  REGION 1..29: note = C-term amide
HGQGTFTSDYSKYLDXXAAREFIAWLLNT

SEQ ID NO: 481 - protein, 29 aa, synthetic construct
  REGION 1..29: note = Synthetic peptide
  MOD_RES 2: note = Aib
  MOD_RES 17: note = Lys(C8)
  REGION 1..29: note = C-term amide
HXQGTFTSDYSKYLDAXAAKEFIAWLLNT

SEQ ID NO: 482 - protein, 29 aa, synthetic construct
  REGION 1..29: note = Synthetic peptide
  MOD_RES 2: note = Aib
  MOD_RES 17: note = Lys(C12)
  REGION 1..29: note = C-term amide
HXQGTFTSDYSKYLDAXAAKEFIAWLLNT

SEQ ID NO: 483 - protein, 29 aa, synthetic construct
  REGION 1..29: note = Synthetic peptide
  MOD_RES 2: note = Aib
  MOD_RES 17: note = Lys(C14)
  REGION 1..29: note = C-term amide
HXQGTFTSDYSKYLDAXAAKEFIAWLLNT

SEQ ID NO: 484 - protein, 29 aa, synthetic construct
  REGION 1..29: note = Synthetic peptide
  MOD_RES 2: note = Aib
  MOD_RES 17: note = Lys(C16)
  REGION 1..29: note = C-term amide
HXQGTFTSDYSKYLDAXAAKEFIAWLLNT

SEQ ID NO: 485 - protein, 29 aa, synthetic construct
  REGION 1..29: note = Synthetic peptide
  MOD_RES 2: note = Aib
  MOD_RES 17: note = Lys(C18)
  REGION 1..29: note = C-term amide
HXQGTFTSDYSKYLDAXAAKEFIAWLLNT

SEQ ID NO: 486 - protein, 29 aa, synthetic construct
  REGION 1..29: note = Synthetic peptide
  MOD_RES 2: note = Aib
  MOD_RES 17: note = Lys(C20)
  REGION 1..29: note = C-term amide
HXQGTFTSDYSKYLDAXAAKEFIAWLLNT

SEQ ID NO: 487 - protein, 29 aa, synthetic construct
  REGION 1..29: note = Synthetic peptide
  MOD_RES 2: note = Aib
  MOD_RES 17: note = Lys(C8)
  REGION 1..29: note = C-term amide
HXQGTFTSDYSKYLDAXAAREFIAWLLNT

SEQ ID NO: 488 - protein, 29 aa, synthetic construct
  REGION 1..29: note = Synthetic peptide
  MOD_RES 2: note = Aib
  MOD_RES 17: note = Lys(C12)
  REGION 1..29: note = C-term amide
HXQGTFTSDYSKYLDAXAAREFIAWLLNT

SEQ ID NO: 489 - protein, 29 aa, synthetic construct
  REGION 1..29: note = Synthetic peptide
  MOD_RES 2: note = Aib
  MOD_RES 17: note = Lys(C14)
  REGION 1..29: note = C-term amide
HXQGTFTSDYSKYLDAXAAREFIAWLLNT

SEQ ID NO: 490 - protein, 29 aa, synthetic construct
  REGION 1..29: note = Synthetic peptide
  MOD_RES 2: note = Aib
  MOD_RES 17: note = Lys(C16)
  REGION 1..29: note = C-term amide
HXQGTFTSDYSKYLDAXAAREFIAWLLNT

SEQ ID NO: 491 - protein, 29 aa, synthetic construct
  REGION 1..29: note = Synthetic peptide
  MOD_RES 2: note = Aib
  MOD_RES 17: note = Lys(C18)
  REGION 1..29: note = C-term amide
HXQGTFTSDYSKYLDAXAAREFIAWLLNT

SEQ ID NO: 492 - protein, 29 aa, synthetic construct
  REGION 1..29: note = Synthetic peptide
  MOD_RES 2: note = Aib
  MOD_RES 17: note = Lys(C20)
  REGION 1..29: note = C-term amide
HXQGTFTSDYSKYLDAXAAREFIAWLLNT

SEQ ID NO: 493 - protein, 29 aa, synthetic construct
  REGION 1..29: note = Synthetic peptide
  MOD_RES 24: note = Lys(C8)
  REGION 1..29: note = C-term amide
HGQGTFTSDYSKYLDAQAAREFIXWLLNT

SEQ ID NO: 494 - protein, 29 aa, synthetic construct
  REGION 1..29: note = Synthetic peptide
  MOD_RES 24: note = Lys(C12)
  REGION 1..29: note = C-term amide
HGQGTFTSDYSKYLDAQAAREFIXWLLNT

SEQ ID NO: 495 - protein, 29 aa, synthetic construct
  REGION 1..29: note = Synthetic peptide
  MOD_RES 24: note = Lys(C14)
  REGION 1..29: note = C-term amide
HGQGTFTSDYSKYLDAQAAREFIXWLLNT

SEQ ID NO: 496 - protein, 29 aa, synthetic construct
  REGION 1..29: note = Synthetic peptide
  MOD_RES 24: note = Lys(C16)
  REGION 1..29: note = C-term amide
HGQGTFTSDYSKYLDAQAAREFIXWLLNT

SEQ ID NO: 497 - protein, 29 aa, synthetic construct
  REGION 1..29: note = Synthetic peptide
  MOD_RES 24: note = Lys(C18)
  REGION 1..29: note = C-term amide
HGQGTFTSDYSKYLDAQAAREFIXWLLNT

SEQ ID NO: 498 - protein, 29 aa, synthetic construct
  REGION 1..29: note = Synthetic peptide
  MOD_RES 24: note = Lys(C20)
  REGION 1..29: note = C-term amide
HGQGTFTSDYSKYLDAQAAREFIXWLLNT

SEQ ID NO: 499 - protein, 29 aa, synthetic construct
  REGION 1..29: note = Synthetic peptide
  MOD_RES 20: note = Lys(C8)
  REGION 1..29: note = C-term amide
HGQGTFTSDYSKYLDARRAXDFVQWLLNT

SEQ ID NO: 500 - protein, 29 aa, synthetic construct
  REGION 1..29: note = Synthetic peptide
  MOD_RES 20: note = Lys(12)
  REGION 1..29: note = C-term amide
HGQGTFTSDYSKYLDARRAXDFVQWLLNT

SEQ ID NO: 501 - protein, 29 aa, synthetic construct
  REGION 1..29: note = Synthetic peptide
  MOD_RES 20: note = Lys(C14)
  REGION 1..29: note = C-term amide
HGQGTFTSDYSKYLDARRAXDFVQWLLNT

SEQ ID NO: 502 - protein, 29 aa, synthetic construct
  REGION 1..29: note = Synthetic peptide
  MOD_RES 20: note = Lys(C16)
  REGION 1..29: note = C-term amide
HGQGTFTSDYSKYLDARRAXDFVQWLLNT

SEQ ID NO: 503 - protein, 29 aa, synthetic construct
  REGION 1..29: note = Synthetic peptide
  MOD_RES 20: note = Lys(C18)
  REGION 1..29: note = C-term amide
HGQGTFTSDYSKYLDARRAXDFVQWLLNT

SEQ ID NO: 504 - protein, 29 aa, synthetic construct
  REGION 1..29: note = Synthetic peptide
  MOD_RES 20: note = Lys(C20)
  REGION 1..29: note = C-term amide
HGQGTFTSDYSKYLDARRAXDFVQWLLNT

SEQ ID NO: 505 - protein, 29 aa, synthetic construct
  REGION 1..29: note = Synthetic peptide
  MOD_RES 2: note = Aib
  MOD_RES 20: note = Lys(C18)
  REGION 1..29: note = C-term amide
HXQGTFTSDYSKYLDARRAXDFVQWLLNT

SEQ ID NO: 506 - protein, 29 aa, synthetic construct
  REGION 1..29: note = Synthetic peptide
  MOD_RES 2: note = Aib
  MOD_RES 20: note = Lys(C8)
  REGION 1..29: note = C-term amide
HXQGTFTSDYSKYLDARRAXDFVQWLLNT

SEQ ID NO: 507 - protein, 29 aa, synthetic construct
  REGION 1..29: note = Synthetic peptide
  MOD_RES 2: note = Aib
  MOD_RES 20: note = Lys(C14)
  REGION 1..29: note = C-term amide
HXQGTFTSDYSKYLDARRAXDFVQWLLNT

SEQ ID NO: 508 - protein, 29 aa, synthetic construct
  REGION 1..29: note = Synthetic peptide
  MOD_RES 2: note = Aib
  MOD_RES 20: note = Lys(C16)
  REGION 1..29: note = C-term amide
HXQGTFTSDYSKYLDARRAXDFVQWLLNT

SEQ ID NO: 509 - protein, 29 aa, synthetic construct
  REGION 1..29: note = Synthetic peptide
  MOD_RES 2: note = Aib
  MOD_RES 20: note = Lys(C20)
  REGION 1..29: note = C-term amide
HXQGTFTSDYSKYLDARRAXDFVQWLLNT

SEQ ID NO: 510 - protein, 29 aa, synthetic construct
  REGION 1..29: note = Synthetic peptide
  MOD_RES 24: note = Lys(C8)
  REGION 1..29: note = C-term amide
HGQGTFTSDYSKYLDARRAQDFVXWLLNT

SEQ ID NO: 511 - protein, 29 aa, synthetic construct
  REGION 1..29: note = Synthetic peptide
  MOD_RES 24: note = Lys(C12)
  REGION 1..29: note = C-term amide
HGQGTFTSDYSKYLDARRAQDFVXWLLNT

SEQ ID NO: 512 - protein, 29 aa, synthetic construct
  REGION 1..29: note = Synthetic peptide
  MOD_RES 24: note = Lys(C14)
  REGION 1..29: note = C-term amide
HGQGTFTSDYSKYLDARRAQDFVXWLLNT

SEQ ID NO: 513 - protein, 29 aa, synthetic construct
  REGION 1..29: note = Synthetic peptide
  MOD_RES 24: note = Lys(C16)
  REGION 1..29: note = C-term amide
HGQGTFTSDYSKYLDARRAQDFVXWLLNT

SEQ ID NO: 514 - protein, 29 aa, synthetic construct
  REGION 1..29: note = Synthetic peptide
  MOD_RES 24: note = Lys(C18)
  REGION 1..29: note = C-term amide
HGQGTFTSDYSKYLDARRAQDFVXWLLNT

SEQ ID NO: 515 - protein, 29 aa, synthetic construct
  REGION 1..29: note = Synthetic peptide
  MOD_RES 24: note = Lys(C20)
  REGION 1..29: note = C-term amide
HGQGTFTSDYSKYLDARRAQDFVXWLLNT

SEQ ID NO: 516 - protein, 29 aa, synthetic construct
  REGION 1..29: note = Synthetic peptide
  MOD_RES 2: note = Aib
  MOD_RES 16: note = Aib
  MOD_RES 17: note = Lys(C18)
  REGION 1..29: note = C-term amide
HXQGTFTSDYSKYLDXXAAKEFIAWLLNT

SEQ ID NO: 517 - protein, 29 aa, synthetic construct
  REGION 1..29: note = Synthetic peptide
  MOD_RES 2: note = Aib
  MOD_RES 16: note = Aib
  MOD_RES 17: note = Lys(C8)
  REGION 1..29: note = C-term amide
HXQGTFTSDYSKYLDXXAAKEFIAWLLNT

SEQ ID NO: 518 - protein, 29 aa, synthetic construct
  REGION 1..29: note = Synthetic peptide
  MOD_RES 2: note = Aib
  MOD_RES 16: note = Aib
  MOD_RES 17: note = Lys(C12)
  REGION 1..29: note = C-term amide
HXQGTFTSDYSKYLDXXAAKEFIAWLLNT

SEQ ID NO: 519 - protein, 29 aa, synthetic construct
  REGION 1..29: note = Synthetic peptide
  MOD_RES 2: note = Aib
  MOD_RES 16: note = Aib
  MOD_RES 17: note = Lys(C14)
  REGION 1..29: note = C-term amide
HXQGTFTSDYSKYLDXKAAKEFIAWLLNT

SEQ ID NO: 520 - protein, 29 aa, synthetic construct
  REGION 1..29: note = Synthetic peptide
  MOD_RES 2: note = Aib
  MOD_RES 16: note = Aib
  MOD_RES 17: note = Lys(C16)
  REGION 1..29: note = C-term amide
HXQGTFTSDYSKYLDXXAAKEFIAWLLNT

SEQ ID NO: 521 - protein, 29 aa, synthetic construct
  REGION 1..29: note = Synthetic peptide
  MOD_RES 2: note = Aib
  MOD_RES 16: note = Aib
  MOD_RES 17: note = Lys(C18)
  REGION 1..29: note = C-term amide
HXQGTFTSDYSKYLDXXAAKEFIAWLLNT

SEQ ID NO: 522 - protein, 29 aa, synthetic construct
  REGION 1..29: note = Synthetic peptide
  MOD_RES 2: note = Aib
  MOD_RES 16: note = Aib
  MOD_RES 17: note = Lys(C20)
  REGION 1..29: note = C-term amide
HXQGTFTSDYSKYLDXXAAKEFIAWLLNT

SEQ ID NO: 523 - protein, 29 aa, synthetic construct
  REGION 1..29: note = Synthetic peptide
  MOD_RES 2: note = Aib
  MOD_RES 16: note = Aib
  MOD_RES 17: note = Lys(C8)
  REGION 1..29: note = C-term amide
HXQGTFTSDYSKYLDXXAAREFIAWLLNT

SEQ ID NO: 524 - protein, 29 aa, synthetic construct
  REGION 1..29: note = Synthetic peptide
  MOD_RES 2: note = Aib
  MOD_RES 16: note = Aib
  MOD_RES 17: note = Lys(C12)
  REGION 1..29: note = C-term amide
HXQGTFTSDYSKYLDXXAAREFIAWLLNT

SEQ ID NO: 525 - protein, 29 aa, synthetic construct
  REGION 1..29: note = Synthetic peptide
  MOD_RES 2: note = Aib
  MOD_RES 16: note = Aib
  MOD_RES 17: note = Lys(C14)
  REGION 1..29: note = C-term amide
HXQGTFTSDYSKYLDXXAAREFIAWLLNT

SEQ ID NO: 526 - protein, 29 aa, synthetic construct
  REGION 1..29: note = Synthetic peptide
  MOD_RES 2: note = Aib
  MOD_RES 16: note = Aib
  MOD_RES 17: note = Lys(C16)
  REGION 1..29: note = C-term amide
HXQGTFTSDYSKYLDXXAAREFIAWLLNT

SEQ ID NO: 527 - protein, 29 aa, synthetic construct
  REGION 1..29: note = Synthetic peptide
  MOD_RES 2: note = Aib
  MOD_RES 16: note = Aib
  MOD_RES 17: note = Lys(C18)
  REGION 1..29: note = C-term amide
HXQGTFTSDYSKYLDXXAAREFIAWLLNT

SEQ ID NO: 528 - protein, 29 aa, synthetic construct
  REGION 1..29: note = Synthetic peptide
  MOD_RES 2: note = Aib
  MOD_RES 16: note = Aib
  MOD_RES 17: note = Lys(C20)
  REGION 1..29: note = C-term amide
HXQGTFTSDYSKYLDXXAAREFIAWLLNT

SEQ ID NO: 529 - protein, 29 aa, synthetic construct
  REGION 1..29: note = Synthetic peptide
  MOD_RES 2: note = Aib
  MOD_RES 16: note = Aib
  MOD_RES 20: note = Lys(C18)
  REGION 1..29: note = C-term amide
HXQGTFTSDYSKYLDXRRAXDFVQWLLNT

SEQ ID NO: 530 - protein, 29 aa, synthetic construct
  REGION 1..29: note = Synthetic peptide
  MOD_RES 2: note = Aib
  MOD_RES 16: note = Aib
  MOD_RES 20: note = Lys(C8)
  REGION 1..29: note = C-term amide
HXQGTFTSDYSKYLDXRRAXDFVQWLLNT

SEQ ID NO: 531 - protein, 29 aa, synthetic construct
  REGION 1..29: note = Synthetic peptide
  MOD_RES 2: note = Aib
  MOD_RES 16: note = Aib
  MOD_RES 20: note = Lys(C14)
  REGION 1..29: note = C-term amide
HXQGTFTSDYSKYLDXRRAXDFVQWLLNT

SEQ ID NO: 532 - protein, 29 aa, synthetic construct
  REGION 1..29: note = Synthetic peptide
  MOD_RES 2: note = Aib
  MOD_RES 16: note = Aib
  MOD_RES 20: note = Lys(C16)
  REGION 1..29: note = C-term amide
HXQGTFTSDYSKYLDXRRAXDFVQWLLNT

SEQ ID NO: 533 - protein, 29 aa, synthetic construct
  REGION 1..29: note = Synthetic peptide
  MOD_RES 2: note = Aib
  MOD_RES 16: note = Aib
  MOD_RES 20: note = Lys(C20)
  REGION 1..29: note = C-term amide
HXQGTFTSDYSKYLDXRRAXDFVQWLLNT

SEQ ID NO: 534 - protein, 29 aa, synthetic construct
  REGION 1..29: note = Synthetic peptide
  MOD_RES 16: note = Aib
  MOD_RES 20: note = Lys(C8)
  REGION 1..29: note = C-term amide
HGQGTFTSDYSKYLDXRRAXDFVQWLLNT

SEQ ID NO: 535 - protein, 29 aa, synthetic construct
  REGION 1..29: note = Synthetic peptide
  MOD_RES 16: note = Aib
  MOD_RES 20: note = Lys(C12)
  REGION 1..29: note = C-term amide
HGQGTFTSDYSKYLDXRRAXDFVQWLLNT

SEQ ID NO: 536 - protein, 29 aa, synthetic construct
  REGION 1..29: note = Synthetic peptide
  MOD_RES 16: note = Aib
  MOD_RES 20: note = Lys(C14)
  REGION 1..29: note = C-term amide
HGQGTFTSDYSKYLDXRRAXDFVQWLLNT

SEQ ID NO: 537 - protein, 29 aa, synthetic construct
  REGION 1..29: note = Synthetic peptide
  MOD_RES 16: note = Aib
  MOD_RES 20: note = Lys(C16)
  REGION 1..29: note = C-term amide
HGQGTFTSDYSKYLDXRRAXDFVQWLLNT

SEQ ID NO: 538 - protein, 29 aa, synthetic construct
  REGION 1..29: note = Synthetic peptide
  MOD_RES 16: note = Aib
  MOD_RES 20: note = Lys(C18)
  REGION 1..29: note = C-term amide
HGQGTFTSDYSKYLDXRRAXDFVQWLLNT

SEQ ID NO: 539 - protein, 29 aa, synthetic construct
  REGION 1..29: note = Synthetic peptide
  MOD_RES 16: note = Aib
  MOD_RES 20: note = Lys(C20)
  REGION 1..29: note = C-term amide
HGQGTFTSDYSKYLDXRRAXDFVQWLLNT

SEQ ID NO: 540 - protein, 29 aa, synthetic construct
  REGION 1..29: note = Synthetic peptide
  MOD_RES 16: note = Aib
  MOD_RES 24: note = Lys(C8)
  REGION 1..29: note = C-term amide
HGQGTFTSDYSKYLDXQAAREFIXWLLNT

SEQ ID NO: 541 - protein, 29 aa, synthetic construct
  REGION 1..29: note = Synthetic peptide
  MOD_RES 16: note = Aib
  MOD_RES 24: note = Lys(C12)
  REGION 1..29: note = C-term amide
HGQGTFTSDYSKYLDXQAAREFIXWLLNT

SEQ ID NO: 542 - protein, 29 aa, synthetic construct
  REGION 1..29: note = Synthetic peptide
  MOD_RES 16: note = Aib
  MOD_RES 24: note = Lys(C14)
  REGION 1..29: note = C-term amide
HGQGTFTSDYSKYLDXQAAREFIXWLLNT

SEQ ID NO: 543 - protein, 29 aa, synthetic construct
  REGION 1..29: note = Synthetic peptide
  MOD_RES 16: note = Aib
  MOD_RES 24: note = Lys(C16)
  REGION 1..29: note = C-term amide
HGQGTFTSDYSKYLDXQAAREFIXWLLNT

SEQ ID NO: 544 - protein, 29 aa, synthetic construct
  REGION 1..29: note = Synthetic peptide
  MOD_RES 16: note = Aib
  MOD_RES 24: note = Lys(C18)
  REGION 1..29: note = C-term amide
HGQGTFTSDYSKYLDXQAAREFIXWLLNT

SEQ ID NO: 545 - protein, 29 aa, synthetic construct
  REGION 1..29: note = Synthetic peptide
  MOD_RES 16: note = Aib
  MOD_RES 24: note = Lys(C20)
  REGION 1..29: note = C-term amide
HGQGTFTSDYSKYLDXQAAREFIXWLLNT

SEQ ID NO: 546 - protein, 29 aa, synthetic construct
  REGION 1..29: note = Synthetic peptide
  MOD_RES 16: note = Aib
  MOD_RES 24: note = Lys(C8)
  REGION 1..29: note = C-term amide
HGQGTFTSDYSKYLDXRRAQDFVXWLLNT

SEQ ID NO: 547 - protein, 29 aa, synthetic construct
  REGION 1..29: note = Synthetic peptide
  MOD_RES 16: note = Aib
  MOD_RES 24: note = Lys(C12)
  REGION 1..29: note = C-term amide
HGQGTFTSDYSKYLDXRRAQDFVXWLLNT

SEQ ID NO: 548 - protein, 29 aa, synthetic construct
  REGION 1..29: note = Synthetic peptide
  MOD_RES 16: note = Aib
  MOD_RES 24: note = Lys(C14)
  REGION 1..29: note = C-term amide
HGQGTFTSDYSKYLDXRRAQDFVXWLLNT

SEQ ID NO: 549 - protein, 29 aa, synthetic construct
  REGION 1..29: note = Synthetic peptide
  MOD_RES 16: note = Aib
  MOD_RES 24: note = Lys(C16)
  REGION 1..29: note = C-term amide
HGQGTFTSDYSKYLDXRRAQDFVXWLLNT

SEQ ID NO: 550 - protein, 29 aa, synthetic construct
  REGION 1..29: note = Synthetic peptide
  MOD_RES 16: note = Aib
  MOD_RES 24: note = Lys(C18)
  REGION 1..29: note = C-term amide
HGQGTFTSDYSKYLDXRRAQDFVXWLLNT

SEQ ID NO: 551 - protein, 29 aa, synthetic construct
  REGION 1..29: note = Synthetic peptide
  MOD_RES 16: note = Aib
  MOD_RES 24: note = Lys(C20)
  REGION 1..29: note = C-term amide
HGQGTFTSDYSKYLDXRRAQDFVXWLLNT

SEQ ID NO: 552 - protein, 29 aa, synthetic construct
  REGION 1..29: note = Synthetic peptide
  MOD_RES 24: note = Lys(C8)
  REGION 1..29: note = C-term amide
HGQGTFTSDYSKYLDEQAAREFIXWLLQT

SEQ ID NO: 553 - protein, 29 aa, synthetic construct
  REGION 1..29: note = Synthetic peptide
  MOD_RES 24: note = Lys(C12)
  REGION 1..29: note = C-term amide
HGQGTFTSDYSKYLDEQAAREFIXWLLQT

SEQ ID NO: 554 - protein, 29 aa, synthetic construct
  REGION 1..29: note = Synthetic peptide
  MOD_RES 24: note = Lys(C14)
  REGION 1..29: note = C-term amide
HGQGTFTSDYSKYLDEQAAREFIXWLLQT

SEQ ID NO: 555 - protein, 29 aa, synthetic construct
  REGION 1..29: note = Synthetic peptide
  MOD_RES 24: note = Lys(C16)
  REGION 1..29: note = C-term amide
HGQGTFTSDYSKYLDEQAAREFIXWLLQT

SEQ ID NO: 556 - protein, 29 aa, synthetic construct
  REGION 1..29: note = Synthetic peptide
  MOD_RES 24: note = Lys(C18)
  REGION 1..29: note = C-term amide
HGQGTFTSDYSKYLDEQAAREFIXWLLQT

SEQ ID NO: 557 - protein, 29 aa, synthetic construct
  REGION 1..29: note = Synthetic peptide
  MOD_RES 24: note = Lys(C20)
  REGION 1..29: note = C-term amide
HGQGTFTSDYSKYLDEQAAREFIXWLLQT

SEQ ID NO: 558 - protein, 29 aa, synthetic construct
  REGION 1..29: note = Synthetic peptide
  MOD_RES 17: note = Lys(C8)
  REGION 1..29: note = C-term amide
HGQGTFTSDYSKYLDEXAAREFIAWLLQT

SEQ ID NO: 559 - protein, 29 aa, synthetic construct
  REGION 1..29: note = Synthetic peptide
  MOD_RES 17: note = Lys(C12)
  REGION 1..29: note = C-term amide
HGQGTFTSDYSKYLDEXAAREFIAWLLQT

SEQ ID NO: 560 - protein, 29 aa, synthetic construct
  REGION 1..29: note = Synthetic peptide
  MOD_RES 17: note = Lys(C14)
  REGION 1..29: note = C-term amide
HGQGTFTSDYSKYLDEXAAREFIAWLLQT

SEQ ID NO: 561 - protein, 29 aa, synthetic construct
  REGION 1..29: note = Synthetic peptide
  MOD_RES 17: note = Lys(C16)
  REGION 1..29: note = C-term amide
HGQGTFTSDYSKYLDEXAAREFIAWLLQT

SEQ ID NO: 562 - protein, 29 aa, synthetic construct
  REGION 1..29: note = Synthetic peptide
  MOD_RES 17: note = Lys(C18)
  REGION 1..29: note = C-term amide
HGQGTFTSDYSKYLDEXAAREFIAWLLQT

SEQ ID NO: 563 - protein, 29 aa, synthetic construct
  REGION 1..29: note = Synthetic peptide
  MOD_RES 17: note = Lys(C20)
  REGION 1..29: note = C-term amide
HGQGTFTSDYSKYLDEXAAREFIAWLLQT

SEQ ID NO: 564 - protein, 29 aa, synthetic construct
  REGION 1..29: note = Synthetic peptide
  MOD_RES 17: note = Lys(C8)
  REGION 1..29: note = C-term amide
HGQGTFTSDYSKYLDEXAAKEFIAWLLQT

SEQ ID NO: 565 - protein, 29 aa, synthetic construct
  REGION 1..29: note = Synthetic peptide
  MOD_RES 17: note = Lys(C12)
  REGION 1..29: note = C-term amide
HGQGTFTSDYSKYLDEXAAKEFIAWLLQT

SEQ ID NO: 566 - protein, 29 aa, synthetic construct
  REGION 1..29: note = Synthetic peptide
  MOD_RES 17: note = Lys(C14)
  REGION 1..29: note = C-term amide
HGQGTFTSDYSKYLDEXAAKEFIAWLLQT

SEQ ID NO: 567 - protein, 29 aa, synthetic construct
  REGION 1..29: note = Synthetic peptide
  MOD_RES 17: note = Lys(C16)
  REGION 1..29: note = C-term amide
HGQGTFTSDYSKYLDEXAAKEFIAWLLQT

SEQ ID NO: 568 - protein, 29 aa, synthetic construct
  REGION 1..29: note = Synthetic peptide
  MOD_RES 17: note = Lys(C18)
  REGION 1..29: note = C-term amide
HGQGTFTSDYSKYLDEXAAKEFIAWLLQT

SEQ ID NO: 569 - protein, 29 aa, synthetic construct
  REGION 1..29: note = Synthetic peptide
  MOD_RES 17: note = Lys(C20)
  REGION 1..29: note = C-term amide
HGQGTFTSDYSKYLDEXAAKEFIAWLLQT

SEQ ID NO: 570 - protein, 29 aa, synthetic construct
  REGION 1..29: note = Synthetic peptide
  MOD_RES 2: note = Aib
  MOD_RES 17: note = Lys(C8)
  REGION 1..29: note = C-term amide
HXQGTFTSDYSKYLDEXAAKEFIAWLLQT

SEQ ID NO: 571 - protein, 29 aa, synthetic construct
  REGION 1..29: note = Synthetic peptide
  MOD_RES 2: note = Aib
  MOD_RES 17: note = Lys(C12)
  REGION 1..29: note = C-term amide
HXQGTFTSDYSKYLDEXAAKEFIAWLLQT

SEQ ID NO: 572 - protein, 29 aa, synthetic construct
  REGION 1..29: note = Synthetic peptide
  MOD_RES 2: note = Aib
  MOD_RES 17: note = Lys(C14)
  REGION 1..29: note = C-term amide
HXQGTFTSDYSKYLDEXAAKEFIAWLLQT

SEQ ID NO: 573 - protein, 29 aa, synthetic construct
  REGION 1..29: note = Synthetic peptide
  MOD_RES 2: note = Aib
  MOD_RES 17: note = Lys(C16)
  REGION 1..29: note = C-term amide
HXQGTFTSDYSKYLDEXAAKEFIAWLLQT

SEQ ID NO: 574 - protein, 29 aa, synthetic construct
  REGION 1..29: note = Synthetic peptide
  MOD_RES 2: note = Aib
  MOD_RES 17: note = Lys(C18)
  REGION 1..29: note = C-term amide
HXQGTFTSDYSKYLDEXAAKEFIAWLLQT

SEQ ID NO: 575 - protein, 29 aa, synthetic construct
  REGION 1..29: note = Synthetic peptide
  MOD_RES 2: note = Aib
  MOD_RES 17: note = Lys(C20)
  REGION 1..29: note = C-term amide
HXQGTFTSDYSKYLDEXAAKEFIAWLLQT

SEQ ID NO: 576 - protein, 29 aa, synthetic construct
  REGION 1..29: note = Synthetic peptide
  MOD_RES 2: note = Aib
  MOD_RES 16: note = Aib
  MOD_RES 17: note = Lys(C8)
  REGION 1..29: note = C-term amide
HXQGTFTSDYSKYLDXXAAREFIAWLLQT

SEQ ID NO: 577 - protein, 29 aa, synthetic construct
  REGION 1..29: note = Synthetic peptide
  MOD_RES 2: note = Aib
  MOD_RES 16: note = Aib
  MOD_RES 17: note = Lys(C12)
  REGION 1..29: note = C-term amide
HXQGTFTSDYSKYLDXXAAREFIAWLLQT

SEQ ID NO: 578 - protein, 29 aa, synthetic construct
  REGION 1..29: note = Synthetic peptide
  MOD_RES 2: note = Aib
  MOD_RES 16: note = Aib
  MOD_RES 17: note = Lys(C14)
  REGION 1..29: note = C-term amide
HXQGTFTSDYSKYLDXXAAREFIAWLLQT

SEQ ID NO: 579 - protein, 29 aa, synthetic construct
  REGION 1..29: note = Synthetic peptide
  MOD_RES 2: note = Aib
  MOD_RES 16: note = Aib
  MOD_RES 17: note = Lys(C16)
  REGION 1..29: note = C-term amide
HXQGTFTSDYSKYLDXXAAREFIAWLLQT

SEQ ID NO: 580 - protein, 29 aa, synthetic construct
  REGION 1..29: note = Synthetic peptide
  MOD_RES 2: note = Aib
  MOD_RES 16: note = Aib
  MOD_RES 17: note = Lys(C18)
  REGION 1..29: note = C-term amide
HXQGTFTSDYSKYLDXXAAREFIAWLLQT

SEQ ID NO: 581 - protein, 29 aa, synthetic construct
  REGION 1..29: note = Synthetic peptide
  MOD_RES 2: note = Aib
  MOD_RES 16: note = Aib
  MOD_RES 17: note = Lys(C20)
  REGION 1..29: note = C-term amide
HXQGTFTSDYSKYLDXXAAREFIAWLLQT

SEQ ID NO: 582 - protein, 29 aa, synthetic construct
  REGION 1..29: note = Synthetic peptide
  MOD_RES 20: note = Lys(C8)
  REGION 1..29: note = C-term amide
HGQGTFTSDYSKYLDERRAXDFVQWLLQT

SEQ ID NO: 583 - protein, 29 aa, synthetic construct
  REGION 1..29: note = Synthetic peptide
  MOD_RES 20: note = Lys(C12)
  REGION 1..29: note = C-term amide
HGQGTFTSDYSKYLDERRAXDFVQWLLQT

SEQ ID NO: 584 - protein, 29 aa, synthetic construct
  REGION 1..29: note = Synthetic peptide
  MOD_RES 20: note = Lys(C14)
  REGION 1..29: note = C-term amide
HGQGTFTSDYSKYLDERRAXDFVQWLLQT

SEQ ID NO: 585 - protein, 29 aa, synthetic construct
  REGION 1..29: note = Synthetic peptide
  MOD_RES 20: note = Lys(C16)
  REGION 1..29: note = C-term amide
HGQGTFTSDYSKYLDERRAXDFVQWLLQT

SEQ ID NO: 586 - protein, 29 aa, synthetic construct
  REGION 1..29: note = Synthetic peptide
  MOD_RES 20: note = Lys(C18)
  REGION 1..29: note = C-term amide
HGQGTFTSDYSKYLDERRAXDFVQWLLQT

SEQ ID NO: 587 - protein, 29 aa, synthetic construct
  REGION 1..29: note = Synthetic peptide
  MOD_RES 20: note = Lys(C20)
  REGION 1..29: note = C-term amide
HGQGTFTSDYSKYLDERRAXDFVQWLLQT

SEQ ID NO: 588 - protein, 29 aa, synthetic construct
  REGION 1..29: note = Synthetic peptide
  MOD_RES 2: note = Aib
  MOD_RES 20: note = Lys(C8)
  REGION 1..29: note = C-term amide
HXQGTFTSDYSKYLDERRAXDFVQWLLQT

SEQ ID NO: 589 - protein, 29 aa, synthetic construct
  REGION 1..29: note = Synthetic peptide
  MOD_RES 2: note = Aib
  MOD_RES 20: note = Lys(C12)
  REGION 1..29: note = C-term amide
HXQGTFTSDYSKYLDERRAXDFVQWLLQT

SEQ ID NO: 590 - protein, 29 aa, synthetic construct
  REGION 1..29: note = Synthetic peptide
  MOD_RES 2: note = Aib
  MOD_RES 20: note = Lys(C14)
  REGION 1..29: note = C-term amide
HXQGTFTSDYSKYLDERRAXDFVQWLLQT

SEQ ID NO: 591 - protein, 29 aa, synthetic construct
  REGION 1..29: note = Synthetic peptide
  MOD_RES 2: note = Aib
  MOD_RES 20: note = Lys(C16)
  REGION 1..29: note = C-term amide
HXQGTFTSDYSKYLDERRAXDFVQWLLQT

SEQ ID NO: 592 - protein, 29 aa, synthetic construct
  REGION 1..29: note = Synthetic peptide
  MOD_RES 2: note = Aib
  MOD_RES 20: note = Lys(C18)
  REGION 1..29: note = C-term amide
HXQGTFTSDYSKYLDERRAXDFVQWLLQT

SEQ ID NO: 593 - protein, 29 aa, synthetic construct
  REGION 1..29: note = Synthetic peptide
  MOD_RES 2: note = Aib
  MOD_RES 20: note = Lys(C20)
  REGION 1..29: note = C-term amide
HXQGTFTSDYSKYLDERRAXDFVQWLLQT

SEQ ID NO: 594 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C8)
  REGION 1..29: note = C-term amide
HXQGTFTSDYSKYLDXQAAXEFIXWLMQT

SEQ ID NO: 595 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C12)
  REGION 1..29: note = C-term amide
HXQGTFTSDYSKYLDXQAAXEFIXWLMQT

SEQ ID NO: 596 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C14)
  REGION 1..29: note = C-term amide
HXQGTFTSDYSKYLDXQAAXEFIXWLMQT

SEQ ID NO: 597 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C16)
  REGION 1..29: note = C-term amide
HXQGTFTSDYSKYLDXQAAXEFIKWLMQT

SEQ ID NO: 598 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C18)
  REGION 1..29: note = C-term amide
HXQGTFTSDYSKYLDXQAAXEFIKWLMQT

SEQ ID NO: 599 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C20)
  REGION 1..29: note = C-term amide
HXQGTFTSDYSKYLDXQAAXEFIXWLMQT

SEQ ID NO: 600 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C8)
  REGION 1..29: note = C-term amide
HXQGTFTSDYSKYLDXQAAXEFIXWLLQT

SEQ ID NO: 601 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C12)
  MOD_RES 29: note = Thr C-term amide
HXQGTFTSDYSKYLDXQAAXEFIKWLLQX

SEQ ID NO: 602 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C14)
  REGION 1..29: note = C-term amide
HXQGTFTSDYSKYLDXQAAXEFIXWLLQT

SEQ ID NO: 603 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C16)
  REGION 1..29: note = C-term amide
HXQGTFTSDYSKYLDXQAAXEFIXWLLQT

SEQ ID NO: 604 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C18)
  REGION 1..29: note = C-term amide
HXQGTFTSDYSKYLDXQAAXEFIXWLLQT

SEQ ID NO: 605 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C20)
  REGION 1..29: note = C-term amide
HXQGTFTSDYSKYLDXQAAXEFIXWLLQT

SEQ ID NO: 606 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(M8)
  REGION 1..29: note = C-term amide
HXQGTFTSDYSKYLDXQAAXEFIXWLLQT

SEQ ID NO: 607 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(M12)
  REGION 1..29: note = C-term amide
HXQGTFTSDYSKYLDXQAAXEFIXWLLQT

SEQ ID NO: 608 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(M14)
  REGION 1..29: note = C-term amide
HXQGTFTSDYSKYLDXQAAXEFIXWLLQT

SEQ ID NO: 609 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(M16)
  REGION 1..29: note = C-term amide
HXQGTFTSDYSKYLDXQAAXEFIXWLLQT

SEQ ID NO: 610 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(M18)
  REGION 1..29: note = C-term amide
HXQGTFTSDYSKYLDXQAAXEFIXWLLQT

SEQ ID NO: 611 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(M20)
  REGION 1..29: note = C-term amide
HXQGTFTSDYSKYLDXQAAXEFIXWLLQT

SEQ ID NO: 612 - protein, 29 aa, synthetic construct
  REGION 1..29: note = Synthetic peptide
  MOD_RES 24: note = Lys(M8)
  REGION 1..29: note = C-term amide
HGQGTFTSDYSKYLDEQAAREFIXWLLQT

SEQ ID NO: 613 - protein, 29 aa, synthetic construct
  REGION 1..29: note = Synthetic peptide
  MOD_RES 24: note = Lys(M12)
  REGION 1..29: note = C-term amide
HGQGTFTSDYSKYLDEQAAREFIXWLLQT

SEQ ID NO: 614 - protein, 29 aa, synthetic construct
  REGION 1..29: note = Synthetic peptide
  MOD_RES 24: note = Lys(M14)
  REGION 1..29: note = C-term amide
HGQGTFTSDYSKYLDEQAAREFIXWLLQT

SEQ ID NO: 615 - protein, 29 aa, synthetic construct
  REGION 1..29: note = Synthetic peptide
  MOD_RES 24: note = Lys(M16)
  REGION 1..29: note = C-term amide
HGQGTFTSDYSKYLDEQAAREFIXWLLQT

SEQ ID NO: 616 - protein, 29 aa, synthetic construct
  REGION 1..29: note = Synthetic peptide
  MOD_RES 24: note = Lys(M18)
  REGION 1..29: note = C-term amide
HGQGTFTSDYSKYLDEQAAREFIXWLLQT

SEQ ID NO: 617 - protein, 29 aa, synthetic construct
  REGION 1..29: note = Synthetic peptide
  MOD_RES 24: note = Lys(M20)
  REGION 1..29: note = C-term amide
HGQGTFTSDYSKYLDEQAAREFIXWLLQT

SEQ ID NO: 618 - protein, 29 aa, synthetic construct
  REGION 1..29: note = Synthetic peptide
  MOD_RES 17: note = Lys(M8)
  REGION 1..29: note = C-term amide
HGQGTFTSDYSKYLDEXAAKEFIAWLLNT

SEQ ID NO: 619 - protein, 29 aa, synthetic construct
  REGION 1..29: note = Synthetic peptide
  MOD_RES 17: note = Lys(M12)
  REGION 1..29: note = C-term amide
HGQGTFTSDYSKYLDEXAAKEFIAWLLNT

SEQ ID NO: 620 - protein, 29 aa, synthetic construct
  REGION 1..29: note = Synthetic peptide
  MOD_RES 17: note = Lys(M14)
  REGION 1..29: note = C-term amide
HGQGTFTSDYSKYLDEXAAKEFIAWLLNT

SEQ ID NO: 621 - protein, 29 aa, synthetic construct
  REGION 1..29: note = Synthetic peptide
  MOD_RES 17: note = Lys(M16)
  REGION 1..29: note = C-term amide
HGQGTFTSDYSKYLDEXAAKEFIAWLLNT

SEQ ID NO: 622 - protein, 29 aa, synthetic construct
  REGION 1..29: note = Synthetic peptide
  MOD_RES 17: note = Lys(M18)
  REGION 1..29: note = C-term amide
HGQGTFTSDYSKYLDEXAAKEFIAWLLNT

SEQ ID NO: 623 - protein, 29 aa, synthetic construct
  REGION 1..29: note = Synthetic peptide
  MOD_RES 17: note = Lys(M20)
  REGION 1..29: note = C-term amide
HGQGTFTSDYSKYLDEXAAKEFIAWLLNT

SEQ ID NO: 624 - protein, 29 aa, synthetic construct
  REGION 1..29: note = Synthetic peptide
  MOD_RES 17: note = Lys(M8)
  REGION 1..29: note = C-term amide
HGQGTFTSDYSKYLDEXAAREFIAWLLQT

SEQ ID NO: 625 - protein, 29 aa, synthetic construct
  REGION 1..29: note = Synthetic peptide
  MOD_RES 17: note = Lys(M12)
  REGION 1..29: note = C-term amide
HGQGTFTSDYSKYLDEXAAREFIAWLLQT

SEQ ID NO: 626 - protein, 29 aa, synthetic construct
  REGION 1..29: note = Synthetic peptide
  MOD_RES 17: note = Lys(M14)
  REGION 1..29: note = C-term amide
HGQGTFTSDYSKYLDEXAAREFIAWLLQT

SEQ ID NO: 627 - protein, 29 aa, synthetic construct
  REGION 1..29: note = Synthetic peptide
  MOD_RES 17: note = Lys(M16)
  REGION 1..29: note = C-term amide
HGQGTFTSDYSKYLDEXAAREFIAWLLQT

SEQ ID NO: 628 - protein, 29 aa, synthetic construct
  REGION 1..29: note = Synthetic peptide
  MOD_RES 17: note = Lys(M18)
  REGION 1..29: note = C-term amide
HGQGTFTSDYSKYLDEXAAREFIAWLLQT

SEQ ID NO: 629 - protein, 29 aa, synthetic construct
  REGION 1..29: note = Synthetic peptide
  MOD_RES 17: note = Lys(M20)
  REGION 1..29: note = C-term amide
HGQGTFTSDYSKYLDEXAAREFIAWLLQT

SEQ ID NO: 630 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(Me8)
  REGION 1..29: note = C-term amide
HXQGTFTSDYSKYLDXQAAXEFIXWLLQT

SEQ ID NO: 631 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(Me12)
  REGION 1..29: note = C-term amide
HXQGTFTSDYSKYLDXQAAXEFIXWLLQT

SEQ ID NO: 632 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(Me14)
  REGION 1..29: note = C-term amide
HXQGTFTSDYSKYLDXQAAXEFIXWLLQT

SEQ ID NO: 633 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(Me16)
  REGION 1..29: note = C-term amide
HXQGTFTSDYSKYLDXQAAXEFIXWLLQT

SEQ ID NO: 634 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(Me18)
  REGION 1..29: note = C-term amide
HXQGTFTSDYSKYLDXQAAXEFIXWLLQT

SEQ ID NO: 635 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(Me20)
  REGION 1..29: note = C-term amide
HXQGTFTSDYSKYLDXQAAXEFIXWLLQT

SEQ ID NO: 636 - protein, 29 aa, synthetic construct
  REGION 1..29: note = Synthetic peptide
  MOD_RES 24: note = Lys(Me8)
  REGION 1..29: note = C-term amide
HGQGTFTSDYSKYLDEQAAREFIXWLLQT

SEQ ID NO: 637 - protein, 29 aa, synthetic construct
  REGION 1..29: note = Synthetic peptide
  MOD_RES 24: note = Lys(Me12)
  REGION 1..29: note = C-term amide
HGQGTFTSDYSKYLDEQAAREFIXWLLQT

SEQ ID NO: 638 - protein, 29 aa, synthetic construct
  REGION 1..29: note = Synthetic peptide
  MOD_RES 24: note = Lys(Me14)
  REGION 1..29: note = C-term amide
HGQGTFTSDYSKYLDEQAAREFIXWLLQT

SEQ ID NO: 639 - protein, 29 aa, synthetic construct
  REGION 1..29: note = Synthetic peptide
  MOD_RES 24: note = Lys(Me16)
  REGION 1..29: note = C-term amide
HGQGTFTSDYSKYLDEQAAREFIXWLLQT

SEQ ID NO: 640 - protein, 29 aa, synthetic construct
  REGION 1..29: note = Synthetic peptide
  MOD_RES 24: note = Lys(Me18)
  REGION 1..29: note = C-term amide
HGQGTFTSDYSKYLDEQAAREFIXWLLQT

SEQ ID NO: 641 - protein, 29 aa, synthetic construct
  REGION 1..29: note = Synthetic peptide
  MOD_RES 24: note = Lys(Me20)
  REGION 1..29: note = C-term amide
HGQGTFTSDYSKYLDEQAAREFIXWLLQT

SEQ ID NO: 642 - protein, 29 aa, synthetic construct
  REGION 1..29: note = Synthetic peptide
  MOD_RES 17: note = Lys(Me8)
  REGION 1..29: note = C-term amide
HGQGTFTSDYSKYLDEXAAKEFIAWLLNT

SEQ ID NO: 643 - protein, 29 aa, synthetic construct
  REGION 1..29: note = Synthetic peptide
  MOD_RES 17: note = Lys(Me12)
  REGION 1..29: note = C-term amide
HGQGTFTSDYSKYLDEXAAKEFIAWLLNT

SEQ ID NO: 644 - protein, 29 aa, synthetic construct
  REGION 1..29: note = Synthetic peptide
  MOD_RES 17: note = Lys(Me14)
  REGION 1..29: note = C-term amide
HGQGTFTSDYSKYLDEXAAKEFIAWLLNT

SEQ ID NO: 645 - protein, 29 aa, synthetic construct
  REGION 1..29: note = Synthetic peptide
  MOD_RES 17: note = Lys(Me16)
  REGION 1..29: note = C-term amide
HGQGTFTSDYSKYLDEXAAKEFIAWLLNT

SEQ ID NO: 646 - protein, 29 aa, synthetic construct
  REGION 1..29: note = Synthetic peptide
  MOD_RES 17: note = Lys(Me18)
  REGION 1..29: note = C-term amide
HGQGTFTSDYSKYLDEXAAKEFIAWLLNT

SEQ ID NO: 647 - protein, 29 aa, synthetic construct
  REGION 1..29: note = Synthetic peptide
  MOD_RES 17: note = Lys(Me20)
  REGION 1..29: note = C-term amide
HGQGTFTSDYSKYLDEXAAKEFIAWLLNT

SEQ ID NO: 648 - protein, 29 aa, synthetic construct
  REGION 1..29: note = Synthetic peptide
  MOD_RES 17: note = Lys(Me8)
  REGION 1..29: note = C-term amide
HGQGTFTSDYSKYLDEXAAREFIAWLLQT

SEQ ID NO: 649 - protein, 29 aa, synthetic construct
  REGION 1..29: note = Synthetic peptide
  MOD_RES 17: note = Lys(Me12)
  REGION 1..29: note = C-term amide
HGQGTFTSDYSKYLDEXAAREFIAWLLQT

SEQ ID NO: 650 - protein, 29 aa, synthetic construct
  REGION 1..29: note = Synthetic peptide
  MOD_RES 17: note = Lys(Me14)
  REGION 1..29: note = C-term amide
HGQGTFTSDYSKYLDEXAAREFIAWLLQT

SEQ ID NO: 651 - protein, 29 aa, synthetic construct
  REGION 1..29: note = Synthetic peptide
  MOD_RES 17: note = Lys(Me16)
  REGION 1..29: note = C-term amide
HGQGTFTSDYSKYLDEXAAREFIAWLLQT

SEQ ID NO: 652 - protein, 29 aa, synthetic construct
  REGION 1..29: note = Synthetic peptide
  MOD_RES 17: note = Lys(Me18)
  REGION 1..29: note = C-term amide
HGQGTFTSDYSKYLDEXAAREFIAWLLQT

SEQ ID NO: 653 - protein, 29 aa, synthetic construct
  REGION 1..29: note = Synthetic peptide
  MOD_RES 17: note = Lys(Me20)
  REGION 1..29: note = C-term amide
HGQGTFTSDYSKYLDEXAAREFIAWLLQT

SEQ ID NO: 654 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Lys(C8)
  REGION 1..11: note = C-term amide
HXQGTXTSDXX

SEQ ID NO: 655 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Lys(C12)
  REGION 1..11: note = C-term amide
HXQGTXTSDXX

SEQ ID NO: 656 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Lys(C14)
  REGION 1..11: note = C-term amide
HXQGTXTSDXX

SEQ ID NO: 657 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Lys(C16)
  REGION 1..11: note = C-term amide
HXQGTXTSDXX

SEQ ID NO: 658 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Lys(C18)
  REGION 1..11: note = C-term amide
HXQGTXTSDXX

SEQ ID NO: 659 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Lys(C20)
  REGION 1..11: note = C-term amide
HXQGTXTSDXX

SEQ ID NO: 660 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Lys(C8)
  REGION 1..11: note = C-term amide
HXQGTXTSDXX

SEQ ID NO: 661 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Lys(C12)
  REGION 1..11: note = C-term amide
HXQGTXTSDXX

SEQ ID NO: 662 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Lys(C14)
  REGION 1..11: note = C-term amide
HXQGTXTSDXX

SEQ ID NO: 663 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Lys(C16)
  REGION 1..11: note = C-term amide
HXQGTXTSDXX

SEQ ID NO: 664 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Lys(C18)
  REGION 1..11: note = C-term amide
HXQGTXTSDXX

SEQ ID NO: 665 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Lys(C20)
  REGION 1..11: note = C-term amide
HXQGTXTSDXX

SEQ ID NO: 666 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Lys(C8)
  REGION 1..11: note = C-term amide
HXQGTFTSDXK

SEQ ID NO: 667 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Lys(C12)
  REGION 1..11: note = C-term amide
HXQGTFTSDXK

SEQ ID NO: 668 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Lys(C14)
  REGION 1..11: note = C-term amide
HXQGTFTSDXK

SEQ ID NO: 669 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Lys(C16)
  REGION 1..11: note = C-term amide
HXQGTFTSDXK

SEQ ID NO: 670 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Lys(C18)
  REGION 1..11: note = C-term amide
HXQGTFTSDXK

SEQ ID NO: 671 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Lys(C20)
  REGION 1..11: note = C-term amide
HXQGTFTSDXK

SEQ ID NO: 672 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Lys(C8)
  REGION 1..11: note = C-term amide
HXQGTFTSDXK

SEQ ID NO: 673 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Lys(C12)
  REGION 1..11: note = C-term amide
HXQGTFTSDXK

SEQ ID NO: 674 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Lys(C14)
  REGION 1..11: note = C-term amide
HXQGTFTSDXK

SEQ ID NO: 675 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Lys(C16)
  REGION 1..11: note = C-term amide
HXQGTFTSDXK

SEQ ID NO: 676 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Lys(C18)
  REGION 1..11: note = C-term amide
HXQGTFTSDXK

SEQ ID NO: 677 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Lys(C20)
  REGION 1..11: note = C-term amide
HXQGTFTSDXK

SEQ ID NO: 678 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = C-Alpha-Methyl-Lys(C8)
  REGION 1..11: note = C-term amide
HXQGTXTSDXX

SEQ ID NO: 679 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = C-Alpha-Methyl-Lys(C12)
  REGION 1..11: note = C-term amide
HXQGTXTSDXX

SEQ ID NO: 680 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = C-Alpha-Methyl-Lys(C14)
  REGION 1..11: note = C-term amide
HXQGTXTSDXX

SEQ ID NO: 681 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = C-Alpha-Methyl-Lys(C16)
  REGION 1..11: note = C-term amide
HXQGTXTSDXX

SEQ ID NO: 682 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = C-Alpha-Methyl-Lys(C18)
  REGION 1..11: note = C-term amide
HXQGTXTSDXX

SEQ ID NO: 683 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = C-Alpha-Methyl-Lys(C20)
  REGION 1..11: note = C-term amide
HXQGTXTSDXX

SEQ ID NO: 684 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C8)
  REGION 1..11: note = C-term amide
HXQGTXTSDXX

SEQ ID NO: 685 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C12)
  REGION 1..11: note = C-term amide
HXQGTXTSDXX

SEQ ID NO: 686 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C14)
  REGION 1..11: note = C-term amide
HXQGTXTSDXX

SEQ ID NO: 687 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C16)
  REGION 1..11: note = C-term amide
HXQGTXTSDXX

SEQ ID NO: 688 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C18)
  REGION 1..11: note = C-term amide
HXQGTXTSDXX

SEQ ID NO: 689 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C20)
  REGION 1..11: note = C-term amide
HXQGTXTSDXX

SEQ ID NO: 690 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = C-Alpha-Methyl-Lys(C8)
  REGION 1..11: note = C-term amide
HXQGTXTSDXX

SEQ ID NO: 691 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = C-Alpha-Methyl-Lys(C12)
  REGION 1..11: note = C-term amide
HXQGTXTSDXX

SEQ ID NO: 692 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = C-Alpha-Methyl-Lys(C14)
  REGION 1..11: note = C-term amide
HXQGTXTSDXX

SEQ ID NO: 693 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = C-Alpha-Methyl-Lys(C16)
  REGION 1..11: note = C-term amide
HXQGTXTSDXX

SEQ ID NO: 694 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = C-Alpha-Methyl-Lys(C18)
  REGION 1..11: note = C-term amide
HXQGTXTSDXX

SEQ ID NO: 695 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = C-Alpha-Methyl-Lys(C20)
  REGION 1..11: note = C-term amide
HXQGTXTSDXX

SEQ ID NO: 696 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C8)
  REGION 1..11: note = C-term amide
HXQGTXTSDXX

SEQ ID NO: 697 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C12)
  REGION 1..11: note = C-term amide
HXQGTXTSDXX

SEQ ID NO: 698 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C14)
  REGION 1..11: note = C-term amide
HXQGTXTSDXX

SEQ ID NO: 699 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C16)
  REGION 1..11: note = C-term amide
HXQGTXTSDXX

SEQ ID NO: 700 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C18)
  REGION 1..11: note = C-term amide
HXQGTXTSDXX

SEQ ID NO: 701 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = C-Alpha-Methyl-Lys(C20)
  REGION 1..11: note = C-term amide
HXQGTXTSDXX

SEQ ID NO: 702 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Me8
  REGION 1..11: note = C-term amide
HXQGTXTSDXX

SEQ ID NO: 703 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Me12
  REGION 1..11: note = C-term amide
HXQGTXTSDXX

SEQ ID NO: 704 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Me14
  REGION 1..11: note = C-term amide
HXQGTXTSDXX

SEQ ID NO: 705 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Me16
  REGION 1..11: note = C-term amide
HXQGTXTSDXX

SEQ ID NO: 706 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Me18
  REGION 1..11: note = C-term amide
HXQGTXTSDXX

SEQ ID NO: 707 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = 2-ethyl-biphenylalanine
  MOD_RES 11: note = Me20
  REGION 1..11: note = C-term amide
HXQGTXTSDXX

SEQ ID NO: 708 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Me8
  REGION 1..11: note = C-term amide
HXQGTXTSDXX

SEQ ID NO: 709 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Me12
  REGION 1..11: note = C-term amide
HXQGTXTSDXX

SEQ ID NO: 710 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Me14
  REGION 1..11: note = C-term amide
HXQGTXTSDXX

SEQ ID NO: 711 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Me16
  REGION 1..11: note = C-term amide
HXQGTXTSDXX

SEQ ID NO: 712 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Me18
  REGION 1..11: note = C-term amide
HXQGTXTSDXX

SEQ ID NO: 713 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = 2-ethyl-biphenylalanine
  MOD_RES 11: note = Me20
  REGION 1..11: note = C-term amide
HXQGTXTSDXX

SEQ ID NO: 714 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Me8
  REGION 1..11: note = C-term amide
HXQGTXTSDXX

SEQ ID NO: 715 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Me12
  REGION 1..11: note = C-term amide
HXQGTXTSDXX

SEQ ID NO: 716 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Me14
  REGION 1..11: note = C-term amide
HXQGTXTSDXX

SEQ ID NO: 717 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Me16
  REGION 1..11: note = C-term amide
HXQGTXTSDXX

SEQ ID NO: 718 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = 2-ethyl-biphenylalanine
  MOD_RES 11: note = Me18
  REGION 1..11: note = C-term amide
HXQGTXTSDXX

SEQ ID NO: 719 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Me20
  REGION 1..11: note = C-term amide
HXQGTXTSDXX

SEQ ID NO: 720 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Me8
  REGION 1..11: note = C-term amide
HXQGTXTSDXX

SEQ ID NO: 721 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Me12
  REGION 1..11: note = C-term amide
HXQGTXTSDXX

SEQ ID NO: 722 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Me14
  REGION 1..11: note = C-term amide
HXQGTXTSDXX

SEQ ID NO: 723 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Me16
  REGION 1..11: note = C-term amide
HXQGTXTSDXX

SEQ ID NO: 724 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Me18
  REGION 1..11: note = C-term amide
HXQGTXTSDXX

SEQ ID NO: 725 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = 2-ethyl-biphenylalanine
  MOD_RES 11: note = Me20
  REGION 1..11: note = C-term amide
HXQGTXTSDXX

SEQ ID NO: 726 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = C-Alpha-Methyl-Lys(C8)
  REGION 1..11: note = C-term amide
HXQGTXTSDXX

SEQ ID NO: 727 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = C-Alpha-Methyl-Lys(C12)
  REGION 1..11: note = C-term amide
HXQGTXTSDXX

SEQ ID NO: 728 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = C-Alpha-Methyl-Lys(C14)
  REGION 1..11: note = C-term amide
HXQGTXTSDXX

SEQ ID NO: 729 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = C-Alpha-Methyl-Lys(C16)
  REGION 1..11: note = C-term amide
HXQGTXTSDXX

SEQ ID NO: 730 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = C-Alpha-Methyl-Lys(C18)
  REGION 1..11: note = C-term amide
HXQGTXTSDXX

SEQ ID NO: 731 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = C-Alpha-Methyl-Lys(C20)
  REGION 1..11: note = C-term amide
HXQGTXTSDXX

SEQ ID NO: 732 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = C-Alpha-Methyl-Lys(C8)
  REGION 1..11: note = C-term amide
HXQGTXTSDXX

SEQ ID NO: 733 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = C-Alpha-Methyl-Lys(C12)
  REGION 1..11: note = C-term amide
HXQGTXTSDXX

SEQ ID NO: 734 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = C-Alpha-Methyl-Lys(C14)
  REGION 1..11: note = C-term amide
HXQGTXTSDXX

SEQ ID NO: 735 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = C-Alpha-Methyl-Lys(C16)
  REGION 1..11: note = C-term amide
HXQGTXTSDXX

SEQ ID NO: 736 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = C-Alpha-Methyl-Lys(C18)
  REGION 1..11: note = C-term amide
HXQGTXTSDXX

SEQ ID NO: 737 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = C-Alpha-Methyl-Lys(C20)
  REGION 1..11: note = C-term amide
HXQGTXTSDXX

SEQ ID NO: 738 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = C-Alpha-Methyl-Lys(C8)
  REGION 1..11: note = C-term amide
HXQGTXTSDXX

SEQ ID NO: 739 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = C-Alpha-Methyl-Lys(C12)
  REGION 1..11: note = C-term amide
HXQGTXTSDXX

SEQ ID NO: 740 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = C-Alpha-Methyl-Lys(C14)
  REGION 1..11: note = C-term amide
HXQGTXTSDXX

SEQ ID NO: 741 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = C-Alpha-Methyl-Lys(C16)
  REGION 1..11: note = C-term amide
HXQGTXTSDXX

SEQ ID NO: 742 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = C-Alpha-Methyl-Lys(C18)
  REGION 1..11: note = C-term amide
HXQGTXTSDXX

SEQ ID NO: 743 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = C-Alpha-Methyl-Lys(C20)
  REGION 1..11: note = C-term amide
HXQGTXTSDXX

SEQ ID NO: 744 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = C-Alpha-Methyl-Lys(C8)
  REGION 1..11: note = C-term amide
HXQGTXTSDXX

SEQ ID NO: 745 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = C-Alpha-Methyl-Lys(C12)
  REGION 1..11: note = C-term amide
HXQGTXTSDXX

SEQ ID NO: 746 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = C-Alpha-Methyl-Lys(C14)
  REGION 1..11: note = C-term amide
HXQGTXTSDXX

SEQ ID NO: 747 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = C-Alpha-Methyl-Lys(C16)
  REGION 1..11: note = C-term amide
HXQGTXTSDXX

SEQ ID NO: 748 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = C-Alpha-Methyl-Lys(C18)
  REGION 1..11: note = C-term amide
HXQGTXTSDXX

SEQ ID NO: 749 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = C-Alpha-Methyl-Lys(C20)
  REGION 1..11: note = C-term amide
HXQGTXTSDXX

SEQ ID NO: 750 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Me8
  REGION 1..11: note = C-term amide
HXQGTXTSDXX

SEQ ID NO: 751 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Me12
  REGION 1..11: note = C-term amide
HXQGTXTSDXX

SEQ ID NO: 752 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Me14
  REGION 1..11: note = C-term amide
HXQGTXTSDXX

SEQ ID NO: 753 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Me16
  REGION 1..11: note = C-term amide
HXQGTXTSDXX

SEQ ID NO: 754 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Me18
  REGION 1..11: note = C-term amide
HXQGTXTSDXX

SEQ ID NO: 755 - protein, 11 aa, synthetic construct
  REGION 1..11: note = Synthetic peptide
  MOD_RES 2: note = Alpha-MePro
  MOD_RES 6: note = C-Alpha-Methyl-Phe
  MOD_RES 10: note = Bip
  MOD_RES 11: note = Me20
  REGION 1..11: note = C-term amide
HXQGTXTSDXX

SEQ ID NO: 756 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Me8
  REGION 1..11: note = C-term amide
HXQGTXTSDXX

SEQ ID NO: 757 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Me12
  REGION 1..11: note = C-term amide
HXQGTXTSDXX

SEQ ID NO: 758 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Me14
  REGION 1..11: note = C-term amide
HXQGTXTSDXX

SEQ ID NO: 759 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Me16
  REGION 1..11: note = C-term amide
HXQGTXTSDXX

SEQ ID NO: 760 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Me18
  REGION 1..11: note = C-term amide
HXQGTXTSDXX

SEQ ID NO: 761 - protein, 11 aa, synthetic construct
  REGION 1..11: note = Synthetic peptide
  MOD_RES 2: note = Alpha-MePro
  MOD_RES 6: note = C-Alpha-Methyl-2-flouro-Phe
  MOD_RES 10: note = Bip
  MOD_RES 11: note = Me20
  REGION 1..11: note = C-term amide
HXQGTXTSDXX

SEQ ID NO: 762 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Me8
  REGION 1..11: note = C-term amide
HXQGTXTSDXX

SEQ ID NO: 763 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Me12
  REGION 1..11: note = C-term amide
HXQGTXTSDXX

SEQ ID NO: 764 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Me14
  REGION 1..11: note = C-term amide
HXQGTXTSDXX

SEQ ID NO: 765 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Me16
  REGION 1..11: note = C-term amide
HXQGTXTSDXX

SEQ ID NO: 766 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Me18
  REGION 1..11: note = C-term amide
HXQGTXTSDXX

SEQ ID NO: 767 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Me20
  REGION 1..11: note = C-term amide
HXQGTXTSDXX

SEQ ID NO: 768 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Me8
  REGION 1..11: note = C-term amide
HXQGTXTSDXX

SEQ ID NO: 769 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Me12
  REGION 1..11: note = C-term amide
HXQGTXTSDXX

SEQ ID NO: 770 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Me14
  REGION 1..11: note = C-term amide
HXQGTXTSDXX

SEQ ID NO: 771 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Me16
  REGION 1..11: note = C-term amide
HXQGTXTSDXX

SEQ ID NO: 772 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Me18
  REGION 1..11: note = C-term amide
HXQGTXTSDXX

SEQ ID NO: 773 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Me20
  REGION 1..11: note = C-term amide
HXQGTXTSDXX

SEQ ID NO: 774 - protein, 29 aa, synthetic construct
  REGION 1..29: note = Synthetic peptide
  MOD_RES 2: note = Gly or Aib
  MOD_RES 16: note = Glu, Ser, Ala, Lys or Aib
  MOD_RES 17: note = Gln, Lys or U(X); wherein "U(X)" is a natural or unnatural amino acid comprising a functional group covalently attached to the surfactant X
  MOD_RES 20: note = Lys, Glu or Arg
  MOD_RES 23: note = Ile or Val
  MOD_RES 24: note = Ala or U(X); wherein "U(X)" is a natural or unnatural amino acid comprising a functional group covalently attached to the surfactant X
  MOD_RES 27: note = Met, Val or Leu
  MOD_RES 28: note = Asn, Gln or U(X) with C-term amide; wherein "U(X)" is a natural or unnatural amino acid comprising a functional group covalently attached to the surfactant X
  REGION 1..29: note = C-term amide
HXQGTFTSDYSKYLDXXAAXEFXXWLXXT

SEQ ID NO: 775 - protein, 29 aa, synthetic construct
  REGION 1..29: note = Synthetic peptide
  MOD_RES 2: note = Gly or Aib
  MOD_RES 16: note = Glu, Ala or Aib
  MOD_RES 17: note = Lys or U(X); wherein "U(X)" is a natural or unnatural amino acid comprising a functional group covalently attached to the surfactant X
  MOD_RES 27: note = Leu or Val
  REGION 1..29: note = C-term amide
HXQGTFTSDYSKYLDXXAAKEFIAWLXNT

SEQ ID NO: 776 - protein, 29 aa, synthetic construct
  REGION 1..29: note = Synthetic peptide
  MOD_RES 2: note = Gly or Aib
  MOD_RES 16: note = Glu, Ser, Ala or Aib
  MOD_RES 17: note = Arg, hArg or Gln
  MOD_RES 20: note = Lys or U(X); wherein "U(X)" is a natural or unnatural amino acid comprising a functional group covalently attached to the surfactant X
  MOD_RES 23: note = Ile or Val
  MOD_RES 24: note = Gln, Ala or U(X); wherein "U(X)" is a natural or unnatural amino acid comprising a functional group covalently attached to the surfactant X
  MOD_RES 27: note = Leu or Val
  MOD_RES 28: note = Asn, Gln or U(X); wherein "U(X)" is a natural or unnatural amino acid comprising a functional group covalently attached to the surfactant X
  REGION 1..29: note = C-term amide
HXQGTFTSDYSKYLDXXRAXDFXXWLXXT

SEQ ID NO: 777 - protein, 29 aa, synthetic construct
  REGION 1..29: note = Synthetic peptide
  MOD_RES 2: note = Gly or Aib
  MOD_RES 16: note = Glu, Ser, Ala or Aib
  MOD_RES 17: note = Arg, hArg or Gln
  MOD_RES 20: note = Lys or U(X); wherein "U(X)" is a natural or unnatural amino acid comprising a functional group covalently attached to the surfactant X
  MOD_RES 23: note = Ile or Val
  MOD_RES 24: note = Gln, Ala or U(X); wherein "U(X)" is a natural or unnatural amino acid comprising a functional group covalently attached to the surfactant X
  MOD_RES 27: note = Leu or Val
  MOD_RES 28: note = Asn, Gln or U(X); wherein "U(X)" is a natural or unnatural amino acid comprising a functional group covalently attached to the surfactant X
  REGION 1..29: note = C-term amide
HXQGTFTSDYSKYLDXXRAXDFXXWLXXT

SEQ ID NO: 778 - protein, 29 aa, synthetic construct
  REGION 1..29: note = Synthetic peptide
  MOD_RES 2: note = Aib or Gly
  REGION 16..20: note = misc_feature - Cyclic
  MOD_RES 16: note = Lys or Glu cyclized through side chain to form a lactam linkage
  MOD_RES 17: note = Arg, hArg or Gln
  MOD_RES 20: note = Lys or Glu cyclized through side chain to form a lactam linkage
  MOD_RES 24: note = Lys(N-omega-X)
  MOD_RES 27: note = Met, Val, Leu or Nle
  MOD_RES 28: note = Asn or Gln
  REGION 1..29: note = C-term amide
HXQGTFTSDYSKYLDXXAAXEFIKWLXXT

SEQ ID NO: 779 - protein, 29 aa, synthetic construct
  REGION 1..29: note = Synthetic peptide
  MOD_RES 2: note = Aib or Gly
  MOD_RES 16: note = Glu, Ala or Aib
  MOD_RES 17: note = Lys or Lys(N-omega-X)
  REGION 1..29: note = C-term amide
  REGION 1..29: note = See specification as filed for detailed description of substitutions and preferred embodiments
HXQGTFTSDYSKYLDXXAAKEFIAWLLNT

SEQ ID NO: 780 - protein, 29 aa, synthetic construct
  REGION 1..29: note = Synthetic peptide
  MOD_RES 2: note = Gly or Aib
  MOD_RES 16: note = Glu, Ala or Aib
  MOD_RES 17: note = Arg or hArg
  MOD_RES 20: note = Lys or Lys(N-omega-X)
  MOD_RES 23: note = Ile or Val
  MOD_RES 24: note = Gln or Ala
  MOD_RES 27: note = Leu or Val
  MOD_RES 28: note = Asn or Gln
  REGION 1..29: note = C-term amide
  REGION 1..29: note = See specification as filed for detailed description of substitutions and preferred embodiments
HXQGTFTSDYSKYLDXXRAXDFXXWLXXT

SEQ ID NO: 781 - protein, 11 aa, synthetic construct
  REGION 1..11: note = Synthetic peptide
  MOD_RES 2: note = Gly, Aib or MePro
  MOD_RES 6: note = Phe, 2FPhe, MePhe or 2FMePhe
  MOD_RES 10: note = Tyr, Nal2, Bip, Bip2Et or Bip2EtMeO
  MOD_RES 11: note = Lys or Lys(N-omega-X) with C terminal amide
  REGION 1..11: note = See specification as filed for detailed description of substitutions and preferred embodiments
HXQGTXTSDXX

SEQ ID NO: 782 - protein, 29 aa, synthetic construct
  REGION 1..29: note = Synthetic peptide
HSQGTFTSDYSKYLDSRRAQDFVQWLMNT

SEQ ID NO: 783 - protein, 37 aa, synthetic construct
  REGION 1..37: note = Synthetic polypeptide
HSQGTFTSDYSKYLDSRRAQDFVQWLMNTKRNRNNIA

SEQ ID NO: 784 - skipped

SEQ ID NO: 785 - protein, 29 aa, synthetic construct
  REGION 1..29: note = Synthetic peptide
  MOD_RES 17: note = Lys(N-epsilon-dodecanoyl)
  REGION 1..29: note = C-term amide
HGQGTFTSDYSKYLDEKAAKEFIAWLLNT

SEQ ID NO: 786 - protein, 29 aa, synthetic construct
  REGION 1..29: note = Synthetic peptide
  MOD_RES 17: note = Lys(N-epsilon-hexadecanoyl)
  REGION 1..29: note = C-term amide
HGQGTFTSDYSKYLDEKAAKEFIAWLLNT

SEQ ID NO: 787 - protein, 29 aa, synthetic construct
  REGION 1..29: note = Synthetic peptide
  MOD_RES 17: note = Lys(N-epsilon-octadecanoyl)
  REGION 1..29: note = C-term amide
HGQGTFTSDYSKYLDEKAAKEFIAWLLNT

SEQ ID NO: 788 - protein, 29 aa, synthetic construct
  REGION 1..29: note = Synthetic peptide
  MOD_RES 2: note = Aib
  REGION 16..20: note = misc_feature - Cyclic
  MOD_RES 24: note = Lys(N-epsilon(N-epsilon-hexadecanoyl)
  REGION 1..29: note = C-term amide
HXQGTFTSDYSKYLDEQAAKEFIKWLLNT

SEQ ID NO: 789 - protein, 29 aa, synthetic construct
  REGION 1..29: note = Synthetic peptide
  MOD_RES 2: note = Aib
  REGION 16..20: note = misc_feature - Cyclic
  MOD_RES 24: note = Lys(N-epsilon(N-alpha-octadecanoyl)gamma-glutamyl)
  REGION 1..29: note = C-term amide
HXQGTFTSDYSKYLDEQAAKEFIKWLLNT

SEQ ID NO: 790 - protein, 29 aa, synthetic construct
  REGION 1..29: note = Synthetic peptide
  MOD_RES 2: note = Aib
  REGION 16..20: note = misc_feature - Cyclic
  MOD_RES 24: note = Lys(N-epsilon(N-alpha-hexadecanoyl)-gamma-glutamyl)
  REGION 1..29: note = C-term amide
HXQGTFTSDYSKYLDEQAAKEFIKWLLNT

SEQ ID NO: 791 - protein, 29 aa, synthetic construct
  REGION 1..29: note = Synthetic peptide
  MOD_RES 2: note = Aib
  REGION 16..20: note = misc_feature - Cyclic
  MOD_RES 24: note Lys(N-epsilon-(N-alpha-octadecanoyl(N9-gamma-glutamyl (9-amino-4,7-dioxanonanoyl))))
  REGION 1..29: note = C-term amide
HXQGTFTSDYSKYLDEQAAKEFIKWLLNT

SEQ ID NO: 792 - protein, 29 aa, synthetic construct
  REGION 1..29: note = Synthetic peptide
  MOD_RES 2: note = Aib
  REGION 16..20: note = misc_feature - Cyclic
  MOD_RES 24: note = Lys(N-epsilon(N-alpha-hexadecanoyl(N9-gamma glutamyl (9-amino-4,7-dioxanonanoyl))))
  REGION 1..29: note = C-term amide
HXQGTFTSDYSKYLDEQAAKEFIKWLLNT

SEQ ID NO: 793 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Cys(S-(3-(PEG4-aminoethylacetamide-cholesterol)
  REGION 1..29: note = C-term amide
HXQGTFTSDYSKYLDEQAAKEFICWLLNT

SEQ ID NO: 794 - protein, 29 aa, synthetic construct
  REGION 1..29: note = Synthetic peptide
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Cys(S-(3-(PEG4-aminoethylacetamide-Cholesterol))
  REGION 1..29: note = C-term amide
HGQGTFTSDYSKYLDEQAAKEFICWLLNT

SEQ ID NO: 795 - protein, 29 aa, synthetic construct
  REGION 1..29: note = Synthetic peptide
  MOD_RES 2: note = Gly or Aib
  MOD_RES 17: note = Any natural or unnatural amino acid comprising a functional group covalently attached to the surfactant X
  MOD_RES 28: note = Asn or Gln
  REGION 1..29: note = C-term amide
HXQGTFTSDYSKYLDEXAAKEFIAWLLXT

SEQ ID NO: 796 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Lys or Glu cyclized through side chain to form a lactam linkage
  MOD_RES 20: note = Lys or Glu cyclized through side chain to form a lactam linkage
  MOD_RES 24: note = Lys(N-omega-X)
  MOD_RES 28: note = Asn or Gln
  REGION 1..29: note = C-term amide
HXQGTFTSDYSKYLDXQAAXEFIKWLLXT

SEQ ID NO: 797 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(N-omega-X)
  REGION 1..29: note = C-term amide
  REGION 1..29: note = See specification as filed for detailed description of substitutions and preferred embodiments
HXQGTFTSDYSKYLDXQAAXEFIKWLLQT

SEQ ID NO: 798 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C9)
  REGION 1..29: note = C-term amide
HXQGTFTSDYSKYLDXQAAXEFIXWLLQT

SEQ ID NO: 799 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C10)
  REGION 1..29: note = C-term amide
HXQGTFTSDYSKYLDXQAAXEFIXWLLQT

SEQ ID NO: 800 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(C11)
  REGION 1..29: note = C-term amide
HXQGTFTSDYSKYLDXQAAXEFIXWLLQT

SEQ ID NO: 801 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(alpha-Me8)
  REGION 1..29: note = C-term amide
HXQGTFTSDYSKYLDXQAAXEFIXWLLQT

SEQ ID NO: 802 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(alpha-Me10)
  REGION 1..29: note = C-term amide
HXQGTFTSDYSKYLDXQAAXEFIXWLLQT

SEQ ID NO: 803 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(alpha-Me12)
  REGION 1..29: note = C-term amide
HXQGTFTSDYSKYLDXQAAXEFIXWLLQT

SEQ ID NO: 804 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(alpha-Me14)
  REGION 1..29: note = C-term amide
HXQGTFTSDYSKYLDXQAAXEFIXWLLQT

SEQ ID NO: 805 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(alpha-Me16)
  REGION 1..29: note = C-term amide
HXQGTFTSDYSKYLDXQAAXEFIXWLLQT

SEQ ID NO: 806 - protein, 29 aa, synthetic construct
  REGION 1..29: note = Synthetic peptide
  MOD_RES 2: note = Aib
  REGION 16..20: note = misc_feature - Cyclic
  MOD_RES 16: note = Glu is cyclized through side chain to form a lactam linkage
  MOD_RES 20: note = Lys is cyclized through side chain to form a lactam linkage
  MOD_RES 24: note = Lys(alpha-Me18)
  REGION 1..29: note = C-term amide
HXQGTFTSDYSKYLDXQAAXEFIXWLLQT

SEQ ID NO: 807 - protein, 30 aa, synthetic construct
  REGION 1..30: note = Synthetic polypeptide
HAEGTFTSDVSSYLEGQAAKEFIAWLVKGR

SEQ ID NO: 808 - protein, 17 aa, synthetic construct
  REGION 1..17: note = Synthetic peptide
  REGION 1..17: note = N-term Fmoc
  MOD_RES 2: note = Aib
  MOD_RES 10: note = Bip
  MOD_RES 17: note = Lys(Alloc)-Rink amide resin
HXQGTFTSDXSKYLESX

SEQ ID NO: 809 - protein, 29 aa, synthetic construct
  REGION 1..29: note = Synthetic peptide
  REGION 1..29: note = N-term Boc
  MOD_RES 1: note = His(Trt)
  MOD_RES 2: note = Aib
  MOD_RES 3: note = Gln(Trt)
  MOD_RES 5: note = Thr(tBu)
  MOD_RES 7: note = Thr(tBu)
  MOD_RES 8: note = Ser(tBu)
  MOD_RES 9: note = Asp(OtBu)
  MOD_RES 10: note = Tyr(tBu)
  MOD_RES 11: note = Ser(tBu)
  MOD_RES 12: note = Lys(Boc)
  MOD_RES 13: note = Tyr(tBu)
  MOD_RES 15: note = Asp(OtBu)
  MOD_RES 16: note = Glu(O-allyl)
  MOD_RES 17: note = Gln(Trt)
  MOD_RES 20: note = Lys(Alloc)
  MOD_RES 21: note = Glu(O-tBu)
  MOD_RES 24: note = Lys(Dde)
  MOD_RES 25: note = Trp(Boc)
  MOD_RES 28: note = Gln(Trt)
  MOD_RES 29: note = Thr(tBu)-HMP amide resin
HXXGXFXXXXXXXLXXXAAXXFIXXLLXX

SEQ ID NO: 810 - protein, 11 aa, synthetic construct
  REGION 1..11: note = Synthetic peptide
  MOD_RES 2: note = Aib
  MOD_RES 6: note = C-Alpha-Methyl-Phe
  MOD_RES 10: note = Bip
  MOD_RES 11: note = Lys(C20)
  REGION 1..11: note = C-term amide
HXQGTXTSDXX

SEQ ID NO: 811 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Lys(C8)
  REGION 1..11: note = C-term amide
HXQGTXTSDXX

SEQ ID NO: 812 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Lys(C12)
  REGION 1..11: note = C-term amide
HXQGTXTSDXX

SEQ ID NO: 813 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Lys(C14)
  REGION 1..11: note = C-term amide
HXQGTXTSDXX

SEQ ID NO: 814 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Lys(C16)
  REGION 1..11: note = C-term amide
HXQGTXTSDXX

SEQ ID NO: 815 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Lys(C18)
  REGION 1..11: note = C-term amide
HXQGTXTSDXX

SEQ ID NO: 816 - protein, 11 aa, synthetic construct
  REGION 1..11: note = Synthetic peptide
  MOD_RES 2: note = Aib
  MOD_RES 6: note = C-Alpha-Methyl-2-flouro-Phe
  MOD_RES 10: note = Bip
  MOD_RES 11: note = Lys(C20)
  REGION 1..11: note = C-term amide
HXQGTXTSDXX

SEQ ID NO: 817 - protein, 29 aa, synthetic construct
  REGION 1..29: note = Synthetic peptide
  MOD_RES 17: note = Lys(C8)
  REGION 1..29: note = C-term amide
HGQGTFTSDYSKYLDAXAAREFIAWLLNT

SEQ ID NO: 818 - protein, 29 aa, synthetic construct
  REGION 1..29: note = Synthetic peptide
  MOD_RES 17: note = Lys(C12)
  REGION 1..29: note = C-term amide
HGQGTFTSDYSKYLDAXAAREFIAWLLNT

SEQ ID NO: 819 - protein, 29 aa, synthetic construct
  REGION 1..29: note = Synthetic peptide
  MOD_RES 17: note = Lys(C14)
  REGION 1..29: note = C-term amide
HGQGTFTSDYSKYLDAXAAREFIAWLLNT

What is claimed is:

1. A peptide product comprising a surfactant X covalently attached to a peptide that binds a glucagon receptor and a glucagon like peptide 1 (GLP-1) receptor:

wherein the surfactant X is a 1-alkyl glycoside class surfactant; and the peptide comprises at least amino acid residues $aa_1$-$aa_{28}$ from Formula II:

Formula II (SEQ. ID. NO. 1)

$aa_1$-$aa_2$-$aa_3$-$aa_4$-$aa_5$-$aa_6$-$aa_7$-$aa_8$-$aa_9$-$aa_{10}$-$aa_{11}$-$aa_{12}$-

$aa_{13}$-$aa_{14}$-$aa_{15}$-$aa_{16}$-$aa_{17}$-$aa_{18}$-$aa_{19}$-$aa_{20}$-$aa_{21}$-$aa_{22}$-

$aa_{23}$-$aa_{24}$-$aa_{25}$-$aa_{26}$-$aa_{27}$-$aa_{28}$-$aa_{29}$-$aa_{30}$-$aa_{31}$-$aa_{32}$-

$aa_{33}$-$aa_{34}$-$aa_{35}$-$aa_{36}$-$aa_{37}$-Z wherein:

Z is —OH, —N—$R^4$-His, or —NH—$R^3$, wherein:

$R^3$ is H, or a substituted or unsubstituted $C_1$-$C_{12}$ alkyl; and $R^4$ is a $C_2$-$C_{10}$ acyl group;

$aa_1$ is His, N—$R^4$-His, pGlu-His, or N—$R^3$-His;

$aa_2$ is Ser, D-Ser, Ala, Gly, Pro, MePro, Aib, Ac4c, or Ac5c;

$aa_3$ is Gln or Cit;

$aa_4$ is Gly or D-Ala;

$aa_5$ is Thr or Ser;

$aa_6$ is Phe, Trp, 2FPhe, MePhe, 2FMePhe, or Nal2;

$aa_7$ is Thr or Ser;

$aa_8$ is Ser or Asp;

$aa_9$ is Asp or Glu;

$aa_{10}$ is Tyr, Leu, Met, Nal2, Bip, or Bip2EtMeO;

$aa_{11}$ is Ser, Asn, or Bip;

$aa_{12}$ is Lys, Glu, Ser, or Arg;

$aa_{13}$ is Tyr, Gln, or Cit;

$aa_{14}$ is Leu, Met, or Nle;

$aa_{15}$ is Asp or Glu;

$aa_{16}$ is Glu, or Lys;

$aa_{17}$ is Glu, or Lys;

$aa_{18}$ is Arg, hArg, Ala, Aib, Ac4c, or Ac5c;

$aa_{19}$ is Ala, Val, Aib, Ac4c, or Ac5c;

$aa_{20}$ is Lys, or Glu;

$aa_{21}$ is Asp, Glu, Leu, Aib, Ac4c, or Ac5c;

$aa_{22}$ is Phe, Trp, Nal2, Aib, Ac4c, or Ac5c;

$aa_{23}$ is Val, Ile, Aib, Ac4c, or Ac5c;

$aa_{24}$ is Gln, Ala, Glu, or Cit;

$aa_{25}$ is Trp or Nal2;

$aa_{26}$ is Leu;

$aa_{27}$ is Leu;

$aa_{28}$ is Gin;

$aa_{29}$ is absent, Thr, Gly, Aib, Ac4c, or Ac5c;

$aa_{30}$ is absent, Lys, Aib, Ac4c, Ac5c, or Arg;

$aa_{31}$ is absent, Arg, Aib, Ac4c, or Ac5c;

$aa_{32}$ is absent, Asn, Aib, Ac4c, or Ac5c;

$aa_{33}$ is absent, Arg, Aib, Ac4c, or Ac5c;

$aa_{34}$ is absent, Asn, Aib, Ac4c, or Ac5c;

$aa_{35}$ is absent, Asn, Aib, Ac4c, or Ac5c;

$aa_{36}$ is absent, Ile, Ala, Aib, Ac4c, or Ac5C; and $aa_{37}$ is absent;

wherein $aa_{16}$ and $aa_{20}$ are cyclized to form a lactam linkage; and provided that $aa_{17}$ is covalently attached to the surfactant X.

2. The peptide product of claim 1, wherein the 1-alkyl glycoside class surfactant comprises a substituted or unsubstituted $C_6$-$C_{30}$ alkyl group.

3. The peptide product of claim 1, wherein the 1-alkyl glycoside class surfactant comprises a substituted or unsubstituted $C_6$-$C_{20}$ alkyl group.

4. The peptide product of claim 3, wherein the 1-alkyl glycoside class surfactant comprises a substituted or unsubstituted $C_{12}$-$C_{20}$ alkyl group.

5. The peptide product of claim 4, wherein the surfactant X comprises 1-eicosyl beta-D-glucuronic acid, 1-octadecyl beta-D-glucuronic acid, 1-hexadecyl beta-D-glucuronic acid, 1-tetradecyl beta-D-glucuronic acid, 1-dodecyl beta-D-glucuronic acid, 1-decyl beta-D-glucuronic acid, 1-octyl beta-D-glucuronic acid, 1-eicosyl beta-D-diglucuronic acid, 1-octadecyl beta-D-diglucuronic acid, 1-hexadecyl beta-D-diglucuronic acid, 1-tetradecyl beta-D-diglucuronic acid, 1-dodecyl beta-D-diglucuronic acid, 1-decyl beta-D-diglucuronic acid, 1-octyl beta-D-diglucuronic acid, functionalized 1-eicosyl beta-D-glucose, 1-octadecyl beta-D-glucose, 1-hexadecyl beta-D-glucose, 1-tetradecyl beta-D-glucose, 1-dodecyl beta-D-glucose, 1-decyl beta-D-glucose, 1-octyl beta-D-glucose, 1-eicosyl beta-D-maltoside, 1-octadecyl beta-D-maltoside, 1-hexadecyl beta-D-maltoside, 1-tetradecyl beta-D-maltoside, 1-dodecyl beta-D-maltoside, 1-decyl beta-D-maltoside, 1-octyl beta-D-maltoside, 1-eicosyl beta-D-melibioside, 1-octadecyl beta-D-melibioside, 1-hexadecyl beta-D-melibioside, 1-tetradecyl beta-D-melibioside, 1-dodecyl beta-D-melibioside, 1-decyl beta-D-melibioside, 1-octyl beta-D-melibioside, the corresponding 1-alkyl alpha glycoside, or the corresponding glycoside with a 6-carboxyl group or 6,6'-dicarboxyl groups.

6. The peptide product of claim 1, wherein $aa_{17}$ is a lysine residue attached to X.

7. The peptide product of claim 1, wherein $aa_2$ is a glycine residue.

8. The peptide product of claim 1, wherein $aa_2$ is an Aib residue.

9. The peptide product of claim 1, wherein the peptide comprises one or more Aib residues.

10. The peptide product of claim 1, wherein the surfactant X comprises a dodecyl, tetradecyl, hexadecyl or octadecyl alkyl chain.

11. The peptide product of claim 1, further comprising a covalently linked one or more PEG moieties.

12. The peptide product of claim 11, wherein the one or more PEG moieties is a PEG chain comprising $C_{10}$-$C_{3000}$.

13. A pharmaceutical composition comprising a therapeutically effective amount of a peptide product of claim 1 or a pharmaceutically acceptable salt thereof, and at least one pharmaceutically acceptable carrier or excipient.

14. A method for treatment of insulin resistance comprising administering the pharmaceutical composition of claim 13 to an individual in need thereof.

15. A method for treatment of insulin resistance comprising administering the pharmaceutical composition of claim 13 to an individual in need therein, wherein the peptide product comprises amino acid residues $aa_1$-$aa_{27}$ of SEQ. ID. NO. 1.

16. The method of claim 15, wherein the treatment causes weight loss.

17. The method of claim 15, wherein the treatment prevents or delays type 2 diabetes.

18. The method of claim 15, wherein the treatment delays progression of pre-diabetes to type 2 diabetes.

19. The method of claim 15, wherein the treatment induces satiety and glucose-dependent insulin secretion.

20. The method of claim 15, wherein the treatment treats gestational diabetes.

* * * * *